United States Patent 9,476,039 (POLYNUCLEOTIDES AND POLYPEPTIDES IN PLANTS) - sequence listing, part 2

SEQ ID NO: 2467 - DNA, 2057 bp, Arabidopsis thaliana
ttcccctgagaacgacaggagaaagaataaaaaccctaaatttctttaatttcggcgcttcagattatcgttgttaaaggtttttgattgattttgtttaaatgggcgatcttgctatgtccgtagcagacatcaggatggagaatgagcctgatgatttagctagtgataatgttgctgagattgatgtgagtgatgaagagattgatgctgacgaccttgagagacggatgtggaaagatcgtgtcaggcttaaaagaatcaaagagcgacaaaaagctggctctcaaggagctcaaacgaaggagacacctaagaaaatctctgatcaagctcagaggaagaaaatgtctagagctcaagatggtatccttaagtacatgttgaagcttatggaagtctgcaaagttcgcgggtttgtctatggtataataccggaaaagggcaagcctgtgagtggttcctctgacaatataagagcttggtggaaagagaaagtgaagtttgataagaacggtcctgctgctattgctaaatacgaagaggagtgtttagcgtttgggaaatctgatgggaataggaattcacagtttgttctccaggatttgcaagatgctactttagggtctttgttatcttctttgatgcaacattgtgatcctcctcaaaggaagtatccgttggagaaagggacgcctccgccttggtggccaacggggaatgaagaatggtgggtgaaactcggtctgcctaaaagccagagtcctccttaccgaaaacctcatgatctcaagaagatgtggaaggttggagttttaacggcagtgatcaatcatatgttacctgatattgcaaagattaagaggcatgttcgtcagtcgaaatgtttacaggacaagatgacagctaaagagagtgcgatttggttggcggttttgaaccaagaggaatctttgattcagcagcctagcagtgacaatggaaactccaatgtgactgagacacatcgtaggggtaataacgctgacaggaggaaacctgtggtcaacagtgacagtgactatgatgttgatgggacagaggaagcttcaggttcagtttcatctaaagacagtagaagaaatcagattcaaaaagaacaaccaacagccatctcacattcagtaagagatcaagataaagcagagaaacatcgcagaaggaaaagacctcgaattagatccggaactgtcaatcgacaagaggaagaacaacctgaagctcaacaaagaaacatcttacctgatatgaatcatgttgatgcccctctgctagaatataacatcaacggtactcatcaagaggacgatgttgtcgacccaaatattgccttaggaccagaggataatggtctggaactagtggttcctgagttcaataacaactatacttatcttccacttgttaatgaacaaactatgatgcctgtagacgaaaggccaatgctttatggaccaaaccctaaccaagagcttcaatttgggtcagggtacaacttctacaatccctctgcagtgtttgtacataaccaggaagacgacattctccatacacagatagaaatgaatacacaagcaccacctcacaacagtgggttcgaggaggccccaggaggagtacttcaaccccttggtttactcggaaatgaagacggtgtaacagggagtgagttgcctcagtatcagagtggcattctgtctccattgactgacttggactttgactatggtggttttggtgatgatttctcatggtttggagcttagtgtcttgccattttttttgggagattacatagttcaaaaggacatggcaatagtctggctagtacagttactttctcttcttcatttcttctgatcttatattcttcctctttttttcttataatattttcttagatttgttaagagaaacaattttccttttgaataagttgccagaagaactgctttgcccgttgtaatggtctctagggaaagcagttagcgtatcatcatttgtaaatttactgtgag

SEQ ID NO: 2468 - protein, 567 aa, Arabidopsis thaliana
MGDLAMSVADIRMENEPDDLASDNVAEIDVSDEEIDADDLERRMWKDRVRLKRIKERQKAGSQGAQTKETPKKISDQAQRKKMSRAQDGILKYMLKLMEVCKVRGFVYGIIPEKGKPVSGSSDNIRAWWKEKVKFDKNGPAAIAKYEEECLAFGKSDGNRNSQFVLQDLQDATLGSLLSSLMQHCDPPQRKYPLEKGTPPPWWPTGNEEWWVKLGLPKSQSPPYRKPHDLKKMWKVGVLTAVINHMLPDIAKIKRHVRQSKCLQDKMTAKESAIWLAVLNQEESLIQQPSSDNGNSNVTETHRRGNNADRRKPVVNSDSDYDVDGTEEASGSVSSKDSRRNQIQKEQPTAISHSVRDQDKAEKHRRRKRPRIRSGTVNRQEEEQPEAQQRNILPDMNHVDAPLLEYNINGTHQEDDVVDPNIALGPEDNGLELVVPEFNNNYTYLPLVNEQTMMPVDERPMLYGPNPNQELQFGSGYNFYNPSAVFVHNQEDDILHTQIEMNTQAPPHNSGFEEAPGGVLQPLGLLGNEDGVTGSELPQYQSGILSPLTDLDFDYGGFGDDFSWFGA

SEQ ID NO: 2469 - DNA, 840 bp, Arabidopsis thaliana
atggaggagacagaaaagaataagggcagcataagtatggttgaggctaatctacctcctggttttagattccatcctagagacgacgagctcgtctgtgactacttaatgagaagaaccgttcgcagcctctatcaaccagttgtcttgatcgacgtcgatcttaacaaatgcgagccttgggacattcctcaaacggcgagagtgggagggaaagaatggtacttttacagccaaaaagaccgtaaatacgcaacaggctacagaacaaaccgggctacggccaccggttattggaaagccaccgggaaagatagagcaatccaaagaaacggtggtcttgtgggtatgagaaagacacttgtgttttaccgaggtcgatcccctaaaggtcgtaaaactgattgggtcatgcatgagtttcgtctccaaggaaaacttcttcaccactcccctaattctctcgaggaagagtgggtattgtgtagagttttccacaagaacagcaacggagctgatatagacgacatcacaaggagctgctctgatgcaacagcttctgcattcatggactcttacatcaacttcgaccatcatcacatcatcaatcagcatgtaccctgcttctccaataatttgtcacataaccaaaccaaccaatccggtttaatctccaagaactccagcccattgtttaatgcttcccctgatcaaatgattctcagaactttgctaagtcaactcacaaaaaaagtcgaagaatcacagagtcgtggagacggaagctcagagagccaattgaccgacattggcatcccaagccatgcatggaattactga

SEQ ID NO: 2470 - protein, 279 aa, Arabidopsis thaliana
MEETEKNKGSISMVEANLPPGFRFHPRDDELVCDYLMRRTVRSLYQPVVLIDVDLNKCEPWDIPQTARVGGKEWYFYSQKDRKYATGYRTNRATATGYWKATGKDRAIQRNGGLVGMRKTLVFYRGRSPKGRKTDWVMHEFRLQGKLLHHSPNSLEEEWVLCRVFHKNSNGADIDDITRSCSDATASAFMDSYINFDHHHIINQHVPCFSNNLSHNQTNQSGLISKNSSPLFNASPDQMILRTLLSQLTKKVEESQSRGDGSSESQLTDIGIPSHAWNY

SEQ ID NO: 2471 - DNA, 2022 bp, Arabidopsis thaliana
cgtcgacatgttcatatttgtttctagctaagaagtttgtataaggcagtggacatggctcctgtttcaatgcctccaggtttccggtttcatccaacagacgaagagcttgtcatatactacctcaagcgaaagattaatggtcggactattgagttagagataatacccgagattgatctttacaaatgcgaaccttgggatttacctgggaagtccttgctgccaagtaaagacctagaatggttctttttcagtcctcgagaccggaaatatccaaacggatcaagaacaaaccgggcgaccaaagcaggttactggaaagccaccgggaaagatcgtaaagtgacttcacattcacggatggttggaacaaagaaaacattagtttattaccgaggaagagcgcctcatggctctcgtaccgattgggtcatgcacgagtaccgtcttgaagaacaagaatgtgactctaaatccggtatacaggatgcctatgcactttgtcgagtatttaagaagagtgctttagccaacaaaattgaagaacaacaccatggtacgaagaagaacaaaggaacgactaatagtgaacaatctacttctagtacttgtttgtattctgatggaatgtatgaaaacctcgaaaactcggggtatccagtctcacctgagacaggaggcttaactcaactcggtaataattcgtcgtcggatatggaaacgatagagaataaatggagtcagtttatgtcgcatgacacgtccttcaacttcccacctcagtctcaatatggaacaatctcatatcctccctcgaaggttgatatagcgttagagtgtgcaagactacaaaatcgtatgttgccaccagtaccaccactttacgtagaaggtctcacacacaatgaatattttggaaacaatgtagctaacgatacagatgaaatgttgagcaagattatagcattggctcaagcctcacatgagccacgaaacagtctagactcatgggacggtggttctgcttccgggaacttccatggagactttaactattccggagaaaaagtctcatgcctagaggcgaacgtggaggctgtagatatgcaagaacaccatgtgaattttaaggaagaaagacttgttgaaaacttgagatgggtaggagtatcaagcaaggaacttgaaaagagcttcgttgaagaacactcaacggtaattcctatagaagatatttggagatatcataatgataatcaagaacaagaacatcatgatcaagatggtatggacgttaacaacaacaatggagatgtggatgatgctttcacactcgagttttcggaaaacgaacataacgagaatcttttggacaagaacgatcatgagacaacgagttcctcatgttttgaggtggtaaaaaaagttgaggttagccatggattgtttgtcacaactcgtcaggtaaccaacacattcttccaacagatagtaccatcgcaaaccgttatagtttatataaatccgacggatggcaatgagtgttgtcatagtatgacatcaaaagaggaggttcatgtccgtaaaaagataaatccgcgaatcaacggagtaagctcaacagttcttggacaatggagaaaattcgcgcatgttattggcttcattcctatgcttctattgatgcgttgtgttcatcgaggtaactctaacaaaaacagaggcagtgaaggttactcgaggcagcctacgagaggagattgtaacaatcggggaacaatactcatgatggaaaatgctgtcgtgagaagaaaaatttggaagaagaagaaagagaaaaatatggttgacgaacaaggttttcggtttcaagatagtttcgtattgaagaagttggggctttctcttgctatcatcttagctgtttctaccataagtcttatttgaatactgaggttcaatatatcatatatggcttttcacttttctattgtactcccatttgcctaggtcgtatgc

SEQ ID NO: 2472 - protein, 631 aa, Arabidopsis thaliana
MAPVSMPPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKKSALANKIEEQHHGTKKNKGTTNSEQSTSSTCLYSDGMYENLENSGYPVSPETGGLTQLGNNSSSDMETIENKWSQFMSHDTSFNFPPQSQYGTISYPPSKVDIALECARLQNRMLPPVPPLYVEGLTHNEYFGNNVANDTDEMLSKIIALAQASHEPRNSLDSWDGGSASGNFHGDFNYSGEKVSCLEANVEAVDMQEHHVNFKEERLVENLRWVGVSSKELEKSFVEEHSTVIPIEDIWRYHNDNQEQEHHDQDGMDVNNNNGDVDDAFTLEFSENEHNENLLDKNDHETTSSSCFEVVKKVEVSHGLFVTTRQVTNTFFQQIVPSQTVIVYINPTDGNECCHSMTSKEEVHVRKKINPRINGVSSTVLGQWRKFAHVIGFIPMLLLMRCVHRGNSNKNRGSEGYSRQPTRGDCNNRGTILMMENAVVRRKIWKKKKEKNMVDEQGFRFQDSFVLKKLGLSLAIILAVSTISLI

SEQ ID NO: 2473 - DNA, 1652 bp, Arabidopsis thaliana
taccgtcgacccacgcgtccgagtgtattcaaagtcggaaagaaaccctaaagaagaggattatgggtgctgtatcgatggagtcgcttcctttaggtttcagattcagacctaccgatgaagagctcgtcaatcactacctccgtctcaagatcaacggacgtcactccgatgtccgtgtcatccctgatatcgatgtctgcaaatgggaaccttgggatcttcctgctctctcggtgattaagacggatgatccagagtggttctttttctgccctcgtgatcggaaataccctaatggtcatcgctctaacagagcaactgactctggctattggaaagctactggtaaagatcgtagcatcaagtctaagaagactttaatcggtatgaagaagactcttgtcttctatcgtggacgagctcctaaaggtgagcggactaattggattatgcacgagtatcgtcccactcttaaggatcttgatggcacttcccctggccaaagcccttacgttctttgtcgcctcttccacaagcctgatgatcgggttaatggtgtcaagtccgatgaagcagcttttacggccagcaacaaatactcacctgatgatacatcatctgatcttgttcaagaaacaccttcctctgatgctgctgttgagaaaccatcagattattcaggtggatgcggttatgctcatagtaatagtaccgcagatgggacaatgattgaggcacctgaagagaatctttggttatcttgtgaccttgaagatcaaaaggcaccactaccgtgtatggattctatatatgctggtgatttcagttacgatgagattggattccaatttcaagatggtaccagcgaaccagatgtatcactaacagaattgttggaggaggtgttcaataaccctgatgacttctcttgcgaggaatcgatcagtcgagagaatccagcagtctcaccaaatgggatattttcatctgctaaaatgctgcagtctgcagcaccagaggatgctttcttcaacgacttcatggctttcactgatacagatgctgagatggcgcaattgcagtatggttcagaaggtggagcttctggttggccaagtgacactaattcatactatagtgatttggttcagcaagagcaaatgatcaatcataacacagagaacaacctcacagaagggagagggataaagatccgggctcgacagcctcagaaccggcagagtacaggattgataaaccagggtattgctccaaggagaatccgtctgcagctgcagtctaactctgaagtaaaagaacgagaggaggtgaatgaaggacacactgttattcccgaggccaaagaagctgcagctaaatactcagagaagagtggttctttggttaaacctcaaataaagctcagggcgcggggaactataggccaagtaaaaggagagagatttgcagacgacgaggtacaggtgcagagcacaaagagagagagagagagaatcaaatgtagtttaatgtaattagggatgatgcaatgttagcatgtttgtgtgttgtaacttaaaaacttatttaggaatctgataaaagttactgttgaaaaaagaaaaaaaaaaaaaaaaaaaaaaaaaaaa

SEQ ID NO: 2474 - protein, 491 aa, Arabidopsis thaliana
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 2475 - DNA, 1444 bp, Arabidopsis thaliana
cgtcgactctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaatttaattagatcatgattattatccatgacaataattaatgctgctttgcgc

SEQ ID NO: 2476 - protein, 414 aa, Arabidopsis thaliana
MAIVSSTTSIIPMSNQVNNNEKGIEDNDHRGGQESHVQNEDEADDHDHDMVMPGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEYRLPHHETEKYQKAEISLCRVYKRPGVEDHPSVPRSLSTRHHNHNSSTSSRLALRQQQHHSSSSNHSDNNLNNNNNINNLEKLSTEYSGDGSTTTTTTNSNSDVTIALANQNIYRPMPYDTSNNTLIVSTRNHQDDDETAIVDDLQRLVNYQISDGGNINHQYFQIAQQFHHTQQQNANANALQLVAAATTATTLMPQTQAALAMNMIPAGTIPNNALWDMWNPIVPDGNRDHYTNIPFK

SEQ ID NO: 2477 - DNA, 897 bp, Arabidopsis thaliana
atgagtttgcctccaggattcaggtttcatcccactgatgaagaactggtggcttactatcttgataggaaggtcaacggccaagccattgagctcgagatcatcccagaagttgatctttataaatgcgagccatgggacttgcctgaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttga

SEQ ID NO: 2478 - protein, 298 aa, Arabidopsis thaliana
MSLPPGFRFHPTDEELVAYYLDRKVNGQAIELEIIPEVDLYKCEPWDLPEKSFLPGNDMEWYFYSTRDKKYPNGSRTNRATRAGYWKATGKDRTVESKKMKMGMKKTLVYYRGRAPHGLRTNWVMHEYRLTHAPSSSLKESYALCRVFKKNIQIPKRKGEEEEAEEESTSVGKEEEEEKEKKWRKCDGNYIEDESLKRASAETSSSELTQGVLLDEANSSSIFALHFSSSLLDDHDHLFSNYSHQLPYHPPLQLQDFPQLSMNEAEIMSIQQDFQCRDSMNGTLDEIFSSSATFPASL

SEQ ID NO: 2479 - DNA, 1221 bp, Arabidopsis thaliana
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 2480 - protein, 283 aa, Arabidopsis thaliana
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 2481 - DNA, 1983 bp, Arabidopsis thaliana
gattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaggaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatc

SEQ ID NO: 2482 - protein, 627 aa, Arabidopsis thaliana
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 2483 - DNA, 833 bp, Arabidopsis thaliana
  misc_feature (810)..(810): n is a, c, g, or t
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 2484 - protein, 181 aa, Arabidopsis thaliana
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 2485 - DNA, 789 bp, Arabidopsis thaliana
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 2486 - protein, 175 aa, Arabidopsis thaliana
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 2487 - DNA, 1095 bp, Arabidopsis thaliana
tgtatatatagttagttagttgagataaacttggttaccacttttgtgtggtctttctttttctttttctccattttccatttatcgaccccttgggtgtagctaattactttcgcgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagtataaagaatcaaagttatgaaacattgtaatttgatttccaaattaatctaatgaataaatgtgctttgcaaaaaaaaaaaaaaaaaaaaaaa

SEQ ID NO: 2488 - protein, 245 aa, Arabidopsis thaliana
MGGRKPCCDEVGLRKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRKLIRMGIDPNTHRRFDQQKVNEEETILVNDPKPLSETEVSVALKNDTSAVLSGNLNQLADVDGDDQPWSFLMENDEGGGGDAAGELTMLLSGDITSSCSSSSSLWMKYGEFGYEDLELGCFDV

SEQ ID NO: 2489 - DNA, 1082 bp, Arabidopsis thaliana
cgatcgatcttgaattgattctttgtagtattttatttacatatatatatagatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagcttcagcctcagcaacatgcatatggccatatataaatcttcttgtatattataa

SEQ ID NO: 2490 - protein, 336 aa, Arabidopsis thaliana
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 2491 - DNA, 954 bp, Arabidopsis thaliana
atgggaagacctccttgttgtgacaagtccaatgtcaagaaaggtctctggaccgaggaagaagacgctaagatccttgcttatgttgctatccatggtgtaggaaactggagcttgatccccaaaaaagcaggtctgaatcgatgtggaaagagctgtagactaagatggactaattacttaagacctgaccttaaacatgacagcttctctacccaagaagaagagcttatcattgagtgtcatagagccattggcagcaggtggtcttccattgcacgaaagcttccaggaagaacggataatgatgtgaagaatcactggaacacaaagctgaagaagaagctgatgaaaatggggatagacccggtgactcataaaccggtttctcaactccttgcagaattcagaaacattagcggccatggaaatgcatccttcaaaacagaaccatctaacaactctatactcacacaatccaactcagcttgggaaatgatgagaaacacaacaacaaaccatgagagttattacaccaactctccaatgatgtttacaaattcctctgagtaccaaactactccatttcatttctatagccatccaaatcatctgctcaatggaaccacatcttcatgctcttcctcatcatcttctactagtatcactcagccaaaccaagtacctcaaacaccggttactaacttctactggagcgatttccttctctcggacccggttcctcaagtagtgggatcctcagctactagcgacctcacttttacgcagaacgaacatcatttcaacatcgaagccgaatacatctctcaaaacatcgattcaaaggcctcgggaacatgtcattccgcgagttccttcgttgacgaaatactagataaagaccaagagatgttgtcacagtttcctcaactcttgaatgatttcgattattag

SEQ ID NO: 2492 - protein, 317 aa, Arabidopsis thaliana
MGRPPCCDKSNVKKGLWTEEEDAKILAYVAIHGVGNWSLIPKKAGLNRCGKSCRLRWTNYLRPDLKHDSFSTQEEELIIECHRAIGSRWSSIARKLPGRTDNDVKNHWNTKLKKKLMKMGIDPVTHKPVSQLLAEFRNISGHGNASFKTEPSNNSILTQSNSAWEMMRNTTTNHESYYTNSPMMFTNSSEYQTTPFHFYSHPNHLLNGTTSSCSSSSSSTSITQPNQVPQTPVTNFYWSDFLLSDPVPQVVGSSATSDLTFTQNEHHFNIEAEYISQNIDSKASGTCHSASSFVDEILDKDQEMLSQFPQLLNDFDY

SEQ ID NO: 2493 - DNA, 923 bp, Arabidopsis thaliana
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtacaaaaaaaaaaaaaaaaaaaaaaaaa

SEQ ID NO: 2494 - protein, 225 aa, Arabidopsis thaliana
MVDSHGSDTECSSKKKKEKTKEKGVYRGARMRSWGKWVSEIREPRKKSRIWLGTFPTAEMAARAHDVAALSIKGSSAILNFPELADFLPRPVSLSQQDIQAAAAEAALMDFKTVPFHLQDDSTPLQTRCDTEKIEKWSSSSSSASSSSSSSSSSSSSMLSGELGDIVELPSLENNVKYDCALYDSLEGLVSMPPWLDATENDFRYGDDSVLLDPCLKESFLWNYE

SEQ ID NO: 2495 - DNA, 2052 bp, Arabidopsis thaliana
  misc_feature (2033)..(2033): n is a, c, g, or t
aaaaaaaaaaaaaacctattcccaaagatgaagaacaataacaacaaatcttcttcttcttctagctatgattcttctttgtctccttcttcttcatcctcctcccaccagaactggctctctttctctctctccaacaataacaacaacttcaattcttcctcaaaccctaatctcacttcctccacatcagatcatcatcatcctcacccttctcacctctctctctttcaagctttctccacttctccagtcgaacggcaagatgggtcaccgggagtttcacccagcgatgccacggcggttctttccgtataccccggcggtcctaaacttgagaacttcctcggcggaggagcctcaacgacgacaacaagaccaatgcaacaagtgcaatctcttggcggcgttgtcttctcttccgacctacagccaccgcttcatcctccgtccgccgccgagatctacgactctgagctcaagtcaatagccgctagcttcctaggaaactactccggtggacactcgtcggaggtctctagcgtacataaacaacaaccgaatcctctagctgtctcagaggcttcgcctactccgaagaagaacgtagagagttttggacaacgtacctcgatttatagaggagtcacaagacatagatggactggaagatacgaagctcatctatgggataatagttgccgaagagaaggccaaagcagaaaaggaagacaagtttatttaggtggttatgataaggaagataaagcagctagagcttacgaccttgcagctcttaagtattggggtcctacaactacgactaatttcccgatatcaaattacgaatctgaacttgaagaaatgaaacacatgactcgacaagagttcgttgcttctttaagacggaaaagcagtggattctctaggggtgcctccatgtacagaggcgtcactagacatcatcagcatggtcgatggcaggcacgaattggaagagttgcaggcaacaaagacctttatcttggcacatttagcactcaagaggaagctgcagaagcttatgatatagcagcgatcaaattccgcggtctaaatgcagtcaccaatttcgacatcagtcgatatgatgtcaaatcaattgctagctgtaatctccctgtgggtggactaatgcctaaaccttctccagcaaccgcagcggctgacaaaaccgttgatctttctccatccgactctccatctctaaccacaccgtccctcacgttcaatgtggcaacaccggtcaatgaccatggaggaactttttaccacactggtataccaatcaaaccagacccggctgatcattattggtccaacatctttggattccaggcaaacccgaaagcagaaatgcgaccattagcaaactttgggtcggatcttcataacccttctcctggttatgctataatgccggtaatgcaggaaggtgaaaacaactttggtggtagttttgttgggtctgatgggtataacaatcattccgctgcatcgaacccggtctcagcaattccgctgtcctcgacaactacaatgagtaacggtaacgaagggtatggtggaaacataaactggattaataacaacatttcaagttcttaccaaactgcaaaatcaaatctctctgttttgcacacaccggtttttgggttggaatgagtattcacatcttagtgagaactaaaataaatatgtaggaaaaaaataaggctctgtttgaagaaatcagatattttcttcttagattatttaagtagtttaaaaaaaatattttttaagtgtttcacttttacgtttgtctgctgaccacgaattttgctggatctgacagtactaactctttgtttaatgaccttatgggttccttttttactttccagaacttttatttacttttttcttcatttttcttcattttttttgttgtgggacaatatgaatgattgaagatggaaactgcttgcatgtgaataaacgaaaatcaaacnatcttcggtaacttaaaaa

SEQ ID NO: 2496 - protein, 558 aa, Arabidopsis thaliana
MKNNNNKSSSSSSYDSSLSPSSSSSSHQNWLSFSLSNNNNNFNSSSNPNLTSSTSDHHHPHPSHLSLFQAFSTSPVERQDGSPGVSPSDATAVLSVYPGGPKLENFLGGGASTTTTRPMQQVQSLGGVVFSSDLQPPLHPPSAAEIYDSELKSIAASFLGNYSGGHSSEVSSVHKQQPNPLAVSEASPTPKKNVESFGQRTSIYRGVTRHRWTGRYEAHLWDNSCRREGQSRKGRQVYLGGYDKEDKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPKPSPATAAADKTVDLSPSDSPSLTTPSLTFNVATPVNDHGGTFYHTGIPIKPDPADHYWSNIFGFQANPKAEMRPLANFGSDLHNPSPGYAIMPVMQEGENNFGGSFVGSDGYNNHSAASNPVSAIPLSSTTTMSNGNEGYGGNINWINNNISSSYQTAKSNLSVLHTPVFGLE

SEQ ID NO: 2497 - DNA, 1368 bp, Arabidopsis thaliana
attcttcttctaaaaaatcttgacaactttttgtttttgttttctttctctgaattttttaaaagagagagagctatgtagctatgaaacagtaagagatatagatatagagagacagagaaagatgatgatcagtgaagttaggctaaacccactttctatttatgtataattaggtcaatcacatcaccaatctcctcctccaattctcctcctctccttccaaattctagggttttgcttgtatctcaccccctttctcaattccctagggaaactgtgaatttcatcaaattccattattttttggtcacacccttaaagagatctgagagttctaaagatgatgacagatttatctctcacgagagatgaagatgaagaagaagcaaagcccttagcagaagaagaaggagcgcgtgaagtagcagacagagagcacatgttcgacaaagttgtgactccaagtgatgtcggaaaactaaaccgacttgtgatcccaaagcaacacgcagagagattcttccctttagattcatcttcaaacgagaaaggtttgcttttaaacttcgaagatctcactggcaaatcttggaggttccgttactcttactggaacagtagtcaaagctatgtcatgactaaaggttggagcagattcgttaaagacaaaaagcttgacgccggagatattgtctctttccaaagatgtgtcggagattcaggaagagatagccgtttgtttattgattggaggagaagacctaaagtccctgaccatcctcatttcgccgccggagctatgttccctaggttttacagctttccttcgaccaattacagtctttataatcatcagcagcaacgtcatcatcacagtggtggtggttataattatcatcaaattccgagagaatttggttatggttacttcgttaggtcagtggatcagaggaacaatcctgcggctgcggtggctgatccgttggtgattgaatctgtgccggtgatgatgcacgggagagctaatcaggaacttgttggaacggccgggaagagactgaggctttttggagttgatatggaatgcggcgagagcggaatgaccaacagtacggaggaggaatcatcatcttccggtggaagtttgccacgtggaggcggtggtggtgcttcatcttcctctttctttcagctgagacttggaagcagcagtgaagatgatcacttcactaagaaaggaaagtcttcattgtcttttgatttggatcaataataatgatgatgatgaaattagttggtattttaagaaaaaaaacatacatatataattctatatatatgacaacataatgcattgatttcctt

SEQ ID NO: 2498 - protein, 310 aa, Arabidopsis thaliana
MMTDLSLTRDEDEEEAKPLAEEEGAREVADREHMFDKVVTPSDVGKLNRLVIPKQHAERFFPLDSSSNEKGLLLNFEDLTGKSWRFRYSYWNSSQSYVMTKGWSRFVKDKKLDAGDIVSFQRCVGDSGRDSRLFIDWRRRPKVPDHPHFAAGAMFPRFYSFPSTNYSLYNHQQQRHHHSGGGYNYHQIPREFGYGYFVRSVDQRNNPAAAVADPLVIESVPVMMHGRANQELVGTAGKRLRLFGVDMECGESGMTNSTEEESSSSGGSLPRGGGGGASSSSFFQLRLGSSSEDDHFTKKGKSSLSFDLDQ

SEQ ID NO: 2499 - DNA, 476 bp, Arabidopsis thaliana
aacacacaattcgttgattcatcatatctcctcttcattaatgaatggcctcgtcgactcttctcgagataagaagatgaaaaatccgcgattttcgtttcgcacaaagagtgatgcagatattctcgatgatggttatcgatggagaaagtacggtcagaaatccgtcaagaacagcttgtatcccaggagctattatagatgcacacaacacatgtgtaacgtgaagaagcaagttcagaggctgtcgaaggagacgagcattgtggagacaacttatgaaggaatccataaccatccttgtgaggagctcatgcaaaccctaactcctcttcttcatcaattgcagttcctctctaagttcacctaattatgtttgtatatatattaacgttctaagagcatctccaatggaagtatctcaatgagatacctaacaaaagaaaaaaaatttaaaaaaaaaaaaaaaaaaaaaa

SEQ ID NO: 2500 - protein, 109 aa, Arabidopsis thaliana
MNGLVDSSRDKKMKNPRFSFRTKSDADILDDGYRWRKYGQKSVKNSLYPRSYYRCTQHMCNVKKQVQRLSKETSIVETTYEGIHNHPCEELMQTLTPLLHQLQFLSKFT

SEQ ID NO: 2501 - DNA, 1257 bp, Arabidopsis thaliana
cacaaaccacagtctctctttctctctctatctatcttctctttctctctctatctctatcactgaaacccaaagagatccaccatttgttcttttttccttcacacagagaactgttttcttccacacttcctttttactaggcagtgttaaccaattgagagagaaaaatgatggttgatgaaaatgtggaaaccaaggcctctactttagtggcaagtgttgatcatgggtttggatccgggtcgggtcatgatcatcatgggttatcggcgtctgtgcctcttcttggtgttaactggaagaagagaaggatgcctagacagagacgatcttcttcttcctttaaccttctctctttccctcctcctatgcctcctatttcccacgtgccaactcctctccccgcacgtaaaattgacccaagaaagctaagattcctcttccaaaaggaactcaagaacagtgacgtcagctctctccgacgtatgatactcccgaagaaagccgcggaggctcacttgccggcacttgaatgcaaggaagggattcctataagaatggaagatttggacggttttcacgtttggaccttcaagtataggtactggccaaacaacaatagcagaatgtacgtgctagaaaacacaggcgattttgtgaatgctcatggtctgcagctaggtgacttcatcatggtttaccaagatctctactcaaacaattacgttatacaagcaagaaaagcatcggaagaagaagaagtagacgtaatcaatcttgaagaagacgacgtttacacaaacttaacaaggatcgaaaacactgtggttaacgatcttctcctccaagattttaatcatcacaacaacaacaacaacaacaacagcaacagcaacagcaacaaatgttcttactattatccagtcatagatgatgtcaccacaaacacagagtcttttgtctacgacacgacggctcttacctccaacgatactcctctcgattttttgggtggacatacgacgactactaataattattactccaagttcggaacattcgatggtttgggctccgttgagaatatctctctcgatgacttctactagataatcaatcgatgggctcatggtattcttgatggtgatcagctatttaatatccttataatatatataagaattaaatgcaatttgcatatatattatcaagtgttgtaatataacattacagtttaaaaaaaaaaaaaaaaaa

SEQ ID NO: 2502 - protein, 312 aa, Arabidopsis thaliana
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 2503 - DNA, 813 bp, Arabidopsis thaliana
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 2504 - protein, 185 aa, Arabidopsis thaliana
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 2505 - DNA, 1693 bp, Arabidopsis thaliana
tcgtcttcttaatcgctttctgctctgtttttctcgttcatcaagctacatctactagctctctcagtgattgatttctcacagtttcatcgatttccatgcgtttaagacctaaaaggacttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctcaagggaagcaaaaaccctaaagatagaagcagatgcagttttgtgtgttggtgttactaaagaaagttttgttgacataatggttttgatgttgtggagaagatagagaggtgtgatcgaaattgtaaatctcaggtggttttttttgaaggcaattgtttctcatttagggtttttttctatatgaggattgtctttgaaaagcctttagatgttttctaattcgtaagctctctcaatctttgtaagttttgcctgttgagttattgatacatatgtgagacctactttatttgttttgtgctacatacattgttgatggtttcgtcaaaaaaaaa

SEQ ID NO: 2506 - protein, 332 aa, Arabidopsis thaliana
MAERKKRSSIQTNKPNKKPMKKKPFQLNHLPGLSEDLKTMRKLRFVVNDPYATDYSSSEEEERSQRRKRYVCEIDLPFAQAATQAESESSYCQESNNNGVSKTKISACSKKVLRSKASPVVGRSSTTVSKPVGVRQRKWGKWAAEIRHPITKVRTWLGTYETLEQAADAYATKKLEFDALAAATSAASSVLSNESGSMISASGSSIDLDKKLVDSTLDQQAGESKKASFDFDFADLQIPEMGCFIDDSFIPNACELDFLLTEENNNQMLDDYCGIDDLDIIGLECDGPSELPDYDFSDVEIDLGLIGTTIDKYAFVDHIATTTPTPLNIACP

SEQ ID NO: 2507 - DNA, 903 bp, Arabidopsis thaliana
ccataataatatattaaaactatatactataatctttttacataataaactttgggtcctgcgtcttaatcatagtacttaattttctctgtgtgttttaatatgaataataaaactgaaatgggatcttccacaagtggaaattgctcgtcggtttcaaccactggtttagctaactccggttcagaatctgatctccggcaacgtgatctaatcgacgagcggaagagaaagaggaaacagtcgaacagagaatctgcgaggaggtcgaggatgaggaagcagaagcatttggatgatctcactgctcaggtgactcatctacgtaaagaaaacgctcagatcgtcgccggaatcgccgtcacgacgcagcactacgtcactatcgaggcggagaacgacattctcagagctcaggttcttgaacttaaccaccgtctccaatctcttaacgagatcgttgatttcgtcgaatcttcttcttcaggattcggtatggagaccggtcagggattattcgacggtggattattcgacggcgtgatgaatcctatgaatctagggttttataatcaaccaatcatggcttctgcttctactgctggtgatgttttcaactgttagaaaacttcacatcattatcatcgtgagtgagactaatcatcgcagcaggggtaaaactgtaatttttcttataaattatgtgatgatgctttgtttctttattttataagatggttaattagtgtttaaaactgattgtaatgatagacagtgtaagaaatgtgtgatatcatggagatggtgatgtgagtttggtacaaatattttaagatcttttctttctatatattaaaagtgaagaaataatattttgtcattttcttaaaaaaaaaaaaaaaa

SEQ ID NO: 2508 - protein, 173 aa, Arabidopsis thaliana
MNNKTEMGSSTSGNCSSVSTTGLANSGSESDLRQRDLIDERKRKRKQSNRESARRSRMRKQKHLDDLTAQVTHLRKENAQIVAGIAVTTQHYVTIEAENDILRAQVLELNHRLQSLNEIVDFVESSSSGFGMETGQGLFDGGLFDGVMNPMNLGFYNQPIMASASTAGDVFNC

SEQ ID NO: 2509 - DNA, 1722 bp, Arabidopsis thaliana
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 2510 - protein, 573 aa, Arabidopsis thaliana
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 2511 - DNA, 2031 bp, Arabidopsis thaliana
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 2512 - protein, 444 aa, Arabidopsis thaliana
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 2513 - DNA, 567 bp, Arabidopsis thaliana
atgattagacatctaaaaccctacatggagtcgtctagtgtccatcgctctcattgtttcgatattcttgatggagtcccactacacgacgatcatttcaactcggcattcctaccaaacactgactttaatgttcatttgcagtcaaacgtatcgacccgcatcaacaatcagtctcacttagacccaaatgcagaaaacattttccataacgaaggtcttgctccagaagaaagaagagcaagaagaatggtctctaaccgggaatctgcaaggaggtcacgtatgcgcaaaaagaagcagatcgaagagctgcaacaacaagttgaacaactcatgatgttgaatcatcacttgtctgagaaagtcatcaacttgttggaaagcaaccatcagatcctacaagagaactcacagctgaaagagaaagtctcttcctttcacttgctcatggcagatgtgctattacccatgagaaatgcagagagcaacatcaatgaccgcaatgtgaattatctaagaggagaaccatcaaaccgtcccaccaacagtccctttggtaagtaa

SEQ ID NO: 2514 - protein, 188 aa, Arabidopsis thaliana
MIRHLKPYMESSSVHRSHCFDILDGVPLHDDHFNSAFLPNTDFNVHLQSNVSTRINNQSHLDPNAENIFHNEGLAPEERRARRMVSNRESARRSRMRKKKQIEELQQQVEQLMMLNHHLSEKVINLLESNHQILQENSQLKEKVSSFHLLMADVLLPMRNAESNINDRNVNYLRGEPSNRPTNSPFGK

SEQ ID NO: 2515 - DNA, 1035 bp, Arabidopsis thaliana
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 2516 - protein, 295 aa, Arabidopsis thaliana
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 2517 - DNA, 725 bp, Arabidopsis thaliana
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagtaaatttataaactaaagaagattagtgttaatgaagaacaaatataa

SEQ ID NO: 2518 - protein, 173 aa, Arabidopsis thaliana
MQPQTDVFSLHNYLNSSILQSPYPSNFPISTPFPTNGQNPYLLYGFQSPTNNPQSMSLSSNNSTSDEAEEQQTNNNIINERKQRRMISNRESARRSRMRKQRHLDELWSQVMWLRIENHQLLDKLNNLSESHDKVLQENAQLKEETFELKQVISDMQIQSPFSCFRDDIIPIE

SEQ ID NO: 2519 - DNA, 1766 bp, Arabidopsis thaliana
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 2520 - protein, 519 aa, Arabidopsis thaliana
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 2521 - DNA, 549 bp, Arabidopsis thaliana
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 2522 - protein, 166 aa, Arabidopsis thaliana
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 2523 - DNA, 923 bp, Arabidopsis thaliana
gctacatatatgggttctattagaggaaacattgaagagcctatatctcagtcattaacgaggcagaactctctctatagcttaaagctccatgaggttcaaacccacttaggaagttctggaaaaccactaggaagcatgaaccttgatgagcttctcaagactgtcttgccaccagctgaggaagggcttgttcgtcagggaagcttgacgttacctcgagatctcagtaaaaagacagttgatgaggtctggagagatatccaacaggacaagaatggaaacggtactagtactactactactcataagcagcctacactcggtgaaataacacttgaggatttgttgttgagagctggtgtagtgactgagacagtagtccctcaagaaaatgttgttaacatagcttcaaatgggcaatgggttgagtatcatcatcagcctcaacaacaacaagggtttatgacatatccggtttgcgagatgcaagatatggtgatgatgggtggattatcggatacaccacaagcgcctgggaggaaaagagtagctggagagattgtggagaagactgttgagaggagacagaagaggatgatcaagaacagagaatctgcagcacgttcacgagctaggaaacaggcttatacacatgaattagagatcaaggtttcaaggttagaagaagaaaacgaaaaacttcggaggctaaaggaggtggagaagatcctaccaagtgaaccaccaccagatcctaagtggaagctccggcgaacaaactctgcttctctctgatcctaaagactcttctttctttcttcttctttgtgttggtttatatcagaccgctttgttctttgtatattgtgtagactttattgactttgaacagcatgtctttataaacatttcttgagtgt

SEQ ID NO: 2524 - protein, 262 aa, Arabidopsis thaliana
MGSIRGNIEEPISQSLTRQNSLYSLKLHEVQTHLGSSGKPLGSMNLDELLKTVLPPAEEGLVRQGSLTLPRDLSKKTVDEVWRDIQQDKNGNGTSTTTTHKQPTLGEITLEDLLLRAGVVTETVVPQENVVNIASNGQWVEYHHQPQQQQGFMTYPVCEMQDMVMMGGLSDTPQAPGRKRVAGEIVEKTVERRQKRMIKNRESAARSRARKQAYTHELEIKVSRLEEENEKLRRLKEVEKILPSEPPPDPKWKLRRTNSASL

SEQ ID NO: 2525 - DNA, 1606 bp, Arabidopsis thaliana
gagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattgagctctcttactctctcatcttcttctcctttactatttctcttaaatttagctttggttttagataaatagagagagagagacatgttaagtaggtttcaaattcaatcttgtttagtttgtttcttagtagtttcttttgattgtgatgatcataaagacttgttctttttctcctatattcaacgaattatccactttaa

SEQ ID NO: 2526 - protein, 386 aa, Arabidopsis thaliana
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 2527 - DNA, 1295 bp, Arabidopsis thaliana
tcgaccagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatcatggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattgatcaaatatacacacacactcataatcgttgctagctagctaacgatgaatcatgagtttagtggatatatatatgattaaaagaggttagcttatgaacattaataagagtttggattctatcgagcttcattatgtttgggtcatcgttc

SEQ ID NO: 2528 - protein, 324 aa, Arabidopsis thaliana
MDPVQSHGSQSSLPPPFHARDFQLHLQQQQQEFFLHHHQQQRNQTDGDQQGGSGGNRQIKMDREETSDNIDNIANNSGSEGKDIDIHGGSGEGGGGSGGDHQMTRRPRGRPAGSKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEEDEMQTPVHGGGGGGSLESPPMMGQQLQHQQQAMSGHQGLPPNLLGSVQLQQQHDQSYWSTGRPPY

SEQ ID NO: 2529 - DNA, 1995 bp, Arabidopsis thaliana
atgggttgtgctgcttcaagaattgataatgaagaaaaggttttagtgtgtaggcagagaaagaggctaatgaaaaagttattagggttcaggggagaatttgcagatgcacagttggcttatcttagagctttgaggaacactggtgttactcttaggcaattcactgagtctgagaccttggagcttgaaaacactagttatggtttaagtttgcctttgcctccttcgcctcctcctacattgcctccttcacctccaccacctcctccatttagcccggatttgagaaatcctgagactagtcatgacttggctgatgaggaggaagagggtgaaaatgatggtggtaatgatggaagtggtgcagctcctccgcctccattgccgaattcttggaacatttggaacccttttgagtcacttgagctgcatagtcatccaaatggtgacaatgtagttacacaagttgaactgaagaagaaacaacaaattcagcaagctgaagaggaagattgggcggagacgaagtctcaatttgaggaagaagatgagcaacaagaagcaggaggtacttgccttgatttgagtgttcatcaaatagaggctgttagtggctgtaacatgaagaagccacgtcgtctgaagtttaagctgggagaagttatggacggtaactcatctatgacaagctgctccggtaaagatcttgagaaaactcatgtgactgattgtagaatcaggaggaccttagaaggaatcatcagagagttggatgattattttcttaaagcatcgggttgcgagaaggagatagctgtgatagtagacatcaacagtagggatactgttgatcctttcaggtaccaggaaacaagaaggaagagaagcagctcggcaaaggtattcagtgcattgtcatggagttggtcttcaaagtctcttcagttgggcaaagatgctacaacaagcgggactgttgaaccctgtaggcctggagctcactgcagcacacttgagaagctatacacagctgagaagaaactttaccagctagtcagaaacaaagagattgccaaagtggagcatgagaggaagtctgcattactgcaaaagcaagatggggaaacctatgatttgagcaaaatggagaaagcacgcttgtctttggagagtttggaaaccgagatacagcgtctagaagattccataactacaacacgctcatgtttgcttaacttgatcaatgatgagctgtatccgcagctagttgctttaacttcagggctagcacagatgtggaaaacaatgctcaagtgtcatcaagttcaaattcatatatcccagcaactgaaccatcttccggattacccgagtatagatctcagttcggaatacaaacgccaggcggttaatgaactagagaccgaggttacttgctggtacaatagcttttgcaagttagtaaattcccagcgagaatacgtgaaaacactctgtacgtggatccaacttactgatcgcctctctaacgaagacaaccaaagaagtagcttgcctgttgctgctcgtaagctctgcaaagagtggcagcttgaatacaacctgcgtaggaaatgcaataaacttgagaggaggcttgagaaagagctaatttcactggctgagattgaaagaaggctcgaggggattttagcaatggaagaggaggaagtaagctcaacgagtttgggctctaagcatccgttgtcaatcaaacaagccaagatcgaagccttgagaaaacgagtggatattgagaaaactaagtacttaaactcggtcgaggttagtaagagaatgacactagacaacctcaaatcaagccttcccaatgtctttcagatgttgactgctctagctaatgtctttgccaatgggtttgaatccgttaatggccaaaccggtacagatgtttccgacacatcccaacattccgatgaatctcaaccctaa

SEQ ID NO: 2530 - protein, 664 aa, Arabidopsis thaliana
MGCAASRIDNEEKVLVCRQRKRLMKKLLGFRGEFADAQLAYLRALRNTGVTLRQFTESETLELENTSYGLSLPLPPSPPPTLPPSPPPPPPFSPDLRNPETSHDLADEEEEGENDGGNDGSGAAPPPPLPNSWNIWNPFESLELHSHPNGDNVVTQVELKKKQQIQQAEEEDWAETKSQFEEEDEQQEAGGTCLDLSVHQIEAVSGCNMKKPRRLKFKLGEVMDGNSSMTSCSGKDLEKTHVTDCRIRRTLEGIIRELDDYFLKASGCEKEIAVIVDINSRDTVDPFRYQETRRKRSSSAKVFSALSWSWSSKSLQLGKDATTSGTVEPCRPGAHCSTLEKLYTAEKKLYQLVRNKEIAKVEHERKSALLQKQDGETYDLSKMEKARLSLESLETEIQRLEDSITTTRSCLLNLINDELYPQLVALTSGLAQMWKTMLKCHQVQIHISQQLNHLPDYPSIDLSSEYKRQAVNELETEVTCWYNSFCKLVNSQREYVKTLCTWIQLTDRLSNEDNQRSSLPVAARKLCKEWQLEYNLRRKCNKLERRLEKELISLAEIERRLEGILAMEEEEVSSTSLGSKHPLSIKQAKIEALRKRVDIEKTKYLNSVEVSKRMTLDNLKSSLPNVFQMLTALANVFANGFESVNGQTGTDVSDTSQHSDESQP

SEQ ID NO: 2531 - DNA, 531 bp, Arabidopsis thaliana
atgggttatccggtggggtacactgagctcctcctcccaagaatcttccttcacttactctctctcttaggcttaatacgaacactcatagacacgggttttcggatattgggtctacccgactttctcgaatccgacccggtttcatcgtcatcgtcatggctggaaccaccgtatatgtccacggcggcgcatcatcaccaagaaagctcatttttcttcccagtggcggcgaggctagctggagaaatcttgcccgtcatcagattctcggagctaactcgacccggattcggatccggatccgattgctgcgcggtgtgcctccacgagttcgagaacgatgacgagatccgacggctgacgaattgtcaacacatatttcaccggagctgtttagaccgttggatgatgggttataatcagatgacgtgtccactttgtagaacgccgtttatttctgatgagttacaagttgcttttaaccaacgagtttggtctgaatctgaacttctcgcagaatcaaattag

SEQ ID NO: 2532 - protein, 176 aa, Arabidopsis thaliana
MGYPVGYTELLLPRIFLHLLSLLGLIRTLIDTGFRILGLPDFLESDPVSSSSSWLEPPYMSTAAHHHQESSFFFPVAARLAGEILPVIRFSELTRPGFGSGSDCCAVCLHEFENDDEIRRLTNCQHIFHRSCLDRWMMGYNQMTCPLCRTPFISDELQVAFNQRVWSESELLAESN

SEQ ID NO: 2533 - DNA, 1146 bp, Arabidopsis thaliana
atggatctaacagaccgtcgtaacccttttaacaatcttgtttttccgccgccgcctccgccgccatccacgaccttcacaagccctatattcccacgaacaagctcttccggcaccaatttccccattctggccatcgcagtgattggaatcttagccactgcgttcttacttgtaagttactacatcttcgtgatcaaatgctgtcttaattggcaccaaatcgacatctttcgccgccgcagacgaagcagtgaccaaaaccctctaatgatttactctcctcatgaggtaaacagaggactagacgaatccgccattagagctatcccagtcttcaaattcaagaagagagacgttgttgcaggagaagaagatcagagtaagaactctcaagaatgctctgtttgtttaaacgagtttcaagaagacgagaagctaaggattattcctaactgctgccacgtgtttcacattgattgcattgatatctggcttcagggcaacgcaaattgtcccttgtgcagaaccagcgtttcttgcgaagcaagtttcactcttgacctaatctctgcaccgagctctcctcgggagaatagccctcattctcggaacaggaatctcgaacccggcctggttctaggaggcgatgatgacttcgtcgtcatagagcttggggccagtaatggtaacaacagagaaagcgtgagaaacatagacttccttacggagcaagaaagggttacctcgaatgaggtctcgaccggaaacagcccgaaatcggtgagtcctttgcctataaagtttggtaatcggggaatgtataagaaagaaaggaaatttcacaaagtgacgagtatgggagacgaatgtatcgatactagaggcaaagatggtcattttggtgaaattcagcccataagaagatcgatctcgatggattcatcagtggatcgtcagctgtacttggcggtccaagaggaaatcagccggagaaacaggcagattccggtagctggagacggtgaagatagtagcagtagtggtggtggtaatagcagagtcatgaagagatgtttcttctcttttggaagtagtagaacttcaaaaagttcttcaatattacctgtttatttggaaccctaa

SEQ ID NO: 2534 - protein, 381 aa, Arabidopsis thaliana
MDLTDRRNPFNNLVFPPPPPPPSTTFTSPIFPRTSSSGTNFPILAIAVIGILATAFLLVSYYIFVIKCCLNWHQIDIFRRRRRSSDQNPLMIYSPHEVNRGLDESAIRAIPVFKFKKRDVVAGEEDQSKNSQECSVCLNEFQEDEKLRIIPNCCHVFHIDCIDIWLQGNANCPLCRTSVSCEASFTLDLISAPSSPRENSPHSRNRNLEPGLVLGGDDDFVVIELGASNGNNRESVRNIDFLTEQERVTSNEVSTGNSPKSVSPLPIKFGNRGMYKKERKFHKVTSMGDECIDTRGKDGHFGEIQPIRRSISMDSSVDRQLYLAVQEEISRRNRQIPVAGDGEDSSSSGGGNSRVMKRCFFSFGSSRTSKSSSILPVYLEP

SEQ ID NO: 2535 - DNA, 1407 bp, Arabidopsis thaliana
gacagactctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctctaatggattccagagacatcccaccgtcacataaccagcttcaaccaccaccgggaatgttaatgtctcattaccgtaaccctaacgccgccgcttcaccattaatggttcccacttccacatctcaaccgattcaacaccctcgtcttccttttggcaatcaacaacaatctcaaacgtttcatcagcagcaacaacaacaaatggatcagaagactcttgaatctcttggatttggtgatggatcaccttcttctcaaccgatgcgattcgggatcgatgatcagaatcagcaactgcaagtgaagaagaagcgaggaaggccgagaaagtatactcctgatggtagcattgctttaggtttagctcctacgtctcctcttctctctgcagcttctaattcttacggtgagggtggtgttggagatagtggtggaaatggaaactctgttgatccacctgttaaacgtaacagaggaaggcctcctggttctagtaagaaacagcttgatgctttaggaggaacttcaggagttgggtttacacctcatgtcattgaagtgaacacaggagaggacatagcgtcaaaggtgatggctttttcggatcaagggtcaagaacaatttgtattctctctgcaagtggtgcagtttctagagtgatgcttcgtcaagcttctcattctagtggaatcgttacttatgagggacgatttgagatcattactctctcaggctcagtcttgaattatgaggtaaatggttccaccaacagaagtggtaacttgagtgtggctttggctggacctgatggcggcatcgtaggtggcagtgtagttggtaatctagtagctgcaacacaagtccaggtgatagtgggaagctttgttgcagaagcaaagaaaccgaaacaaagtagtgttaacattgctcgggggcagaatcctgaaccggcttcagcgccggctaacatgttgaactttggatcagtctctcaaggaccatcgagcgagtcatcagaagagaatgagagcggttctcctgcaatgcaccgtgacaataataatgggatatatggagctcaacaacaacaacaacaacaacctcttcatcctcatcagatgcaaatgtaccaacatctttggtctaatcatggtcaataaaatgaagcggaaattaatttgtttccgttttggttacggttatggtttgatttctt

SEQ ID NO: 2536 - protein, 386 aa, Arabidopsis thaliana
MDSRDIPPSHNQLQPPPGMLMSHYRNPNAAASPLMVPTSTSQPIQHPRLPFGNQQQSQTFHQQQQQQMDQKTLESLGFGDGSPSSQPMRFGIDDQNQQLQVKKKRGRPRKYTPDGSIALGLAPTSPLLSAASNSYGEGGVGDSGGNGNSVDPPVKRNRGRPPGSSKKQLDALGGTSGVGFTPHVIEVNTGEDIASKVMAFSDQGSRTICILSASGAVSRVMLRQASHSSGIVTYEGRFEIITLSGSVLNYEVNGSTNRSGNLSVALAGPDGGIVGGSVVGNLVAATQVQVIVGSFVAEAKKPKQSSVNIARGQNPEPASAPANMLNFGSVSQGPSSESSEENESGSPAMHRDNNNGIYGAQQQQQQQPLHPHQMQMYQHLWSNHGQ

SEQ ID NO: 2537 - DNA, 1150 bp, Arabidopsis thaliana
tcgactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaa

SEQ ID NO: 2538 - protein, 233 aa, Arabidopsis thaliana
MSMDCLSYFFNYDPPVQLQDCFIPEMDMIIPETDSFFFQSQPQLEFHQPLFQEEAPSQTHFDPFCDQFLSPQEIFLPNPKNEIFNETHDLDFFLPTPKRQRLVNSSYNCNTQNHFQSRNPNFFDPFGDTDFVPESCTFQEFRVPDFSLAFKVGRGDQDDSKKPTLSSQSIAARGRRRRIAEKTHELGKLIPGGNKLNTAEMFQAAAKYVKFLQSQVGILQLMQTTKKVITNPK

SEQ ID NO: 2539 - DNA, 1311 bp, Arabidopsis thaliana
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 2540 - protein, 348 aa, Arabidopsis thaliana
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 2541 - DNA, 1357 bp, Arabidopsis thaliana
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 2542 - protein, 299 aa, Arabidopsis thaliana
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 2543 - DNA, 1239 bp, Arabidopsis thaliana
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttcctttttt

SEQ ID NO: 2544 - protein, 299 aa, Arabidopsis thaliana
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 2545 - DNA, 2324 bp, Arabidopsis thaliana
tcctgtcccaaaaccaaaagacttgagagtgtgtctttagagagagatcttctctcttttatcttacgactctcacttcttatctcaaatctacttcaactctatttccagtctccacattttcccacaaatttcaactcttgttctcttcctccaaagtaaaaaacaaatcgttgcaagtgaggtttggttttggtgttatagaattatgaagagcgggaagcaatcttcgcaacctgaaaagggtacttccaggatcttgtcactgactgtcctgtttatcgcattttgcggtttctccttctacctcggtggtatattttgctctgagagagacaagattgtagccaaggatgtcacaaggacgactacaaaggctgtagcttcccctaaagaacctacagctactcctattcaaatcaaatccgtttctttcccggagtgcgggtcagagttccaagattacaccccgtgcaccgatccaaagaggtggaagaagtatggtgtccatcgcttaagtttcttggagcgtcattgtcctccggtatatgaaaagaatgagtgtttgattccaccaccagacgggtataaaccgcctataagatggcccaagagccgagaacagtgttggtacaggaacgtgccttatgattggatcaataagcaaaagtctaaccagcattggcttaagaaagaaggagataagttccatttccctggtggtggtaccatgttccctcgtggagttagtcactatgttgatttgatgcaagatctgattcctgaaatgaaagacggaacagtcaggaccgccattgatactggctgtggggttgcgagctggggaggcgatcttttggaccgtgggatactatcactctctcttgctccaagagataaccatgaagctcaggttcaatttgctcttgaacgtggaattcctgcgattctcgggatcatctctacgcaacgtctcccttttccttcaaatgcatttgatatggctcattgttcaagatgtcttattccctggacagaatttggtggaatctatttacttgagattcaccgtatagttcgacctggaggtttttgggttctttctggtccacctgtgaactataatagacgatggcgtggatggaacacaaccatggaagatcagaaatctgactacaacaagcttcagtcacttctaacctccatgtgtttcaaaaagtacgctcaaaaagatgacatagccgtgtggcagaaactctcagacaaatcttgctatgacaaaatcgctaagaacatggaagcttaccctcccaaatgtgacgacagtatagaacctgattctgcttggtacactccactccgtccttgcgtggttgccccgacacctaaagtcaagaagtctggtctcggatcaatcccaaaatggcccgagaggttacatgtcgcgcccgagagaatcggtgatgttcacggagggagtgcgaacagtttgaaacacgatgatggtaaatggaagaacagagttaagcattacaagaaagttttaccagctcttgggacagacaagataagaaatgttatggatatgaacactgtttatggaggtttctctgcggccctcattgaggatcccatttgggtcatgaacgttgtatcatcgtacagcgcaaattcgcttcctgttgtctttgatcgcggtctcatcgggacttaccacgactggtgcgaagctttctcaacgtatccaagaacatatgatcttcttcacctcgacagtctttttaccttggagagtcacaggtgtgagatgaagtacattttgctagagatggacaggatcttgcggccgagtggatatgttataatccgagaatcgagttatttcatggacgcaatcacaacgttagcgaaagggataaggtggagttgccggagagaggagactgagtatgcagtcaaaagtgagaagattctggtttgccagaaaaagctatggttttcgtcaaaccaaacctcttgatgagaccacctgtatcatagtgtttatcatctcctgtgatgcacactacagagagaaggatctagtcctttgagtccaagatatagctctataaacaatctcctttttttgttctctttaatttcttgggtatttcacggtatagattgatattatatattttttaattatatttttaatatatagatatattagtatgtggtttaaacactattattatcaaggtcttaaagatttgctttgcaagagttaaaaaatgttggagtaaggacctcttgattaataaattgactgacgcagcaaa

SEQ ID NO: 2546 - protein, 603 aa, Arabidopsis thaliana
MKSGKQSSQPEKGTSRILSLTVLFIAFCGFSFYLGGIFCSERDKIVAKDVTRTTTKAVASPKEPTATPIQIKSVSFPECGSEFQDYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQKKLWFSSNQTS

SEQ ID NO: 2547 - DNA, 1625 bp, Arabidopsis thaliana
tcttccgtgtgttaacagaagtccccacaattgtctgtcttcgctgcgagacaaaactgccacagccaataatgtttctctgagggaccttgcttctgtcagagactcgctctctctctcctcttcttgctctgctcagctctctcaccaactcatcttcagtcctcaaacaaacatctgttctcatctttgttttctttcctttctttctcatatctcattttcaattttcccaatttctcttcaacatcttcatagcaatttaagaccactattccattataaagctaactgctttagaaactcctcacatttatttcttccccatcattgttttagagagggagaaagaaaaagagctcagctttctgatggagaggagtattcaaggacaaaacaagctctgttgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagaggggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatgc

SEQ ID NO: 2548 - protein, 359 aa, Arabidopsis thaliana
MERSIQGQNKLCCLDQKVNVRRSLQVQETVEDHQSFALEEEEQQLSTPSLLQDTTIPFLQMLQQSEDPSPFLSFKDPSFLALLSLQTLEKPWELENYLPHEVPEFHSPIHSETNHYYHNPSLEGVNEAISNQELPFNPLENARSRRKRKNNNLASLMTREKRKRRRTKPTKNIEEIESQRMTHIAVERNRRRQMNVHLNSLRSIIPSSYIQRGDQASIVGGAIDFVKILEQQLQSLEAQKRSQQSDDNKEQIPEDNSLRNISSNKLRASNKEEQSSKLKIEATVIESHVNLKIQCTRKQGQLLRSIILLEKLRFTVLHLNITSPTNTSVSYSFNLKMEDECNLGSADEITAAIRQIFDS

SEQ ID NO: 2549 - DNA, 1196 bp, Arabidopsis thaliana
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 2550 - protein, 358 aa, Arabidopsis thaliana
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 2551 - DNA, 1118 bp, Arabidopsis thaliana
caaacccaaattctctcagcgccggtcaaatacttgtctctctctctctctctctttcactcttgtcttgtctccttcgaagctgtttgttctgtaagaaagatggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagcccaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaaatttgttgaccgctcgcttctgtgtatctacctttgcatatgatgatgaacagcttaactgtttggtttagatcagatttgtcatatggatttggtaatttaggaagacattttagttttttcattgttacattttggcgattgaagggataactctttgtttaggggtaatgatcttttgctctgttttatgtttgtttattaacattcttcaaactcaatcaaaagtattttggttagtcttaaaa

SEQ ID NO: 2552 - protein, 255 aa, Arabidopsis thaliana
MEAGGAYNPRTVEEVFRDFKGRRAGMIKALTTDVQEFFRLCDPEKENLCLYGHPNEHWEVNLPAEEVPPELPEPVLGINFARDGMAEKDWLSLVAVHSDAWLLAVAFFFGARFGFDKADRKRLFNMVNDLPTIFEVVAGTAKKQGKDKSSVSNNSSNRSKSSSKRGSESRAKFSKPEPKDDEEEEEEGVEEEDEDEQGETQCGACGESYAADEFWICCDLCEMWFHGKCVKITPARAEHIKQYKCPSCSNKRARS

SEQ ID NO: 2553 - DNA, 3174 bp, Arabidopsis thaliana
atggcgagaaattcgaattccgatgaggctttctcgtcagaggaggaagaagagcgggttaaggataatgaagaagaagatgaggaggagctcgaggctgttgctcgttcttctggctccgacgatgacgaagtagccgccgccgacgaatcaccagtctccgacggagaggctgctcccgtagaagatgattacgaggacgaagaagatgaggaaaaagctgaaatcagcaaacgtgagaaagccagacttaaagagatgcagaagttgaagaagcagaagattcaagagatgctggagtcgcagaatgcttccattgacgcggatatgaacaataagggaaaagggagactgaagtatcttctgcagcaaactgagttatttgcccactttgctaaaagtgatggatcttcttctcagaagaaggcaaaaggaaggggacgtcatgcttccaaaataactgaagaggaggaagacgaagagtatctaaaggaagaagaggatggcttaactggatctggaaacacacggttactcacacagccctcttgtattcaagggaagatgagagattaccaattagctggtttgaactggctcattcgtctttatgagaatggcataaatggaattcttgctgatgaaatgggtctggggaagacgcttcaaacgatttctttgttggcatatcttcatgaatacaggggaatcaatggtccccatatggtggttgctccaaaatcaacacttggtaattggatgaacgaaattcgccggttttgtcctgtcctacgtgctgtgaagttccttggtaatcctgaggagaggagacatattcgagaagacctgctagttgctgggaaatttgatatttgtgtcacaagctttgagatggccatcaaagagaagacagcacttcgtcggtttagctggcgttatattatcattgatgaagcgcatcgaatcaagaacgagaattcactcctttctaaaaccatgagactttttagcaccaattatcggcttcttatcacggggaccccccttcagaataatctccatgaactgtgggctcttctaaattttcttctgcctgagatttttagttcagcagagacttttgatgaatggtttcaaatttctggtgagaatgaccagcaagaagttgtgcaacaactgcacaaggttcttcgaccatttcttcttcgaagactaaagtcagatgttgagaaaggtttgccaccgaagaaggagaccatacttaaagttggtatgtctcagatgcaaaagcaatactacaaggctttactgcagaaggatcttgaagcggttaatgctggtggagaacgcaaacgtctgctaaacattgcaatgcaactgcgtaaatgctgcaatcacccctatctcttccagggtgcagaacctggtcccccatataccacaggagatcaccttataacaaatgctggtaagatggttctcttggataaattgcttcctaagttgaaagaacgtgattcaagggtgctgatattttctcagatgacaagacttttggatattcttgaggactatttaatgtatcgtggttacttgtattgccgtattgatggaaacactggtggtgacgaacgagatgcctccatagaagcctacaacaagccaggaagtgagaaatttgttttcttgttatctactagagctggagggcttggtatcaatcttgctactgcagatgttgtgatcctttacgatagtgattggaacccacaagtcgacttgcaagctcaggatcgtgcccataggattggtcaaaaaaaagaagttcaagtgtttcgattctgcactgagtctgctattgaggagaaagtgattgaaagagcttacaagaagttagcacttgatgctctggttattcaacaagggagattggcagaacagaaaagtaagtctgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgcacgatttccagttctttaacattcagagattgaccgagttgtatgaaaaggaagtacgttatctcatgcaaacacatcagaaaaatcagttgaaagacacaattgatgttgaagaaccagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggatgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatga

SEQ ID NO: 2554 - protein, 1057 aa, Arabidopsis thaliana
MARNSNSDEAFSSEEEEERVKDNEEEDEEELEAVARSSGSDDDEVAAADESPVSDGEAAPVEDDYEDEEDEEKAEISKREKARLKEMQKLKKQKIQEMLESQNASIDADMNNKGKGRLKYLLQQTELFAHFAKSDGSSSQKKAKGRGRHASKITEEEEDEEYLKEEEDGLTGSGNTRLLTQPSCIQGKMRDYQLAGLNWLIRLYENGINGILADEMGLGKTLQTISLLAYLHEYRGINGPHMVVAPKSTLGNWMNEIRRFCPVLRAVKFLGNPEERRHIREDLLVAGKFDICVTSFEMAIKEKTALRRFSWRYIIIDEAHRIKNENSLLSKTMRLFSTNYRLLITGTPLQNNLHELWALLNFLLPEIFSSAETFDEWFQISGENDQQEVVQQLHKVLRPFLLRRLKSDVEKGLPPKKETILKVGMSQMQKQYYKALLQKDLEAVNAGGERKRLLNIAMQLRKCCNHPYLFQGAEPGPPYTTGDHLITNAGKMVLLDKLLPKLKERDSRVLIFSQMTRLLDILEDYLMYRGYLYCRIDGNTGGDERDASIEAYNKPGSEKFVFLLSTRAGGLGINLATADVVILYDSDWNPQVDLQAQDRAHRIGQKKEVQVFRFCTESAIEEKVIERAYKKLALDALVIQQGRLAEQKSKSVNKDELLQMVRYGAEMVFSSKDSTITDEDIDRIIAKGEEATAELDAKMKKFTEDAIQFKMDDSADFYDFDDDNKDENKLDFKKIVSDNWNDPPKRERKRNYSESEYFKQTLRQGAPAKPKEPRIPRMPQLHDFQFFNIQRLTELYEKEVRYLMQTHQKNQLKDTIDVEEPEGGDPLTTEEVEEKEGLLEEGFSTWSRRDFNTFLRACEKYGRNDIKSIASEMEGKTEEEVERYAKVFKERYKELNDYDRIIKNIERGEARISRKDEIMKAIGKKLDRYRNPWLELKIQYGQNKGKLYNEECDRFMICMIHKLGYGNWDELKAAFRTSSVFRFDWFVKSRTSQELARRCDTLIRLIEKENQEFDERERQARKEKKLAKSATPSKRPLGRQASESPSSTKKRKHLSMR

SEQ ID NO: 2555 - DNA, 1746 bp, Arabidopsis thaliana
atgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtag

SEQ ID NO: 2556 - protein, 581 aa, Arabidopsis thaliana
MIMYGGGGAGKDGGSTNHLSDGGVILKKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPPDIIPNHQLHPHPHHQQQQQHNHHHHHHQQQQQHQQMYFQPQSSQRNTPSSSPLPSPTPANAKSSSSFTFHTTTANLLHPLSPHTPNTPSQLSSTPPPPPLSSPLCSPRNNQYPTLPLFALPRSQINNNNNGNFTFPRPPPLLQPPSSLFAKRYNNANTPLNCINRVSTAPFSPVSRDSYTSFLTLPYPSPTAQTATYHNTNNPYSSSPSFSLNPSSSSYPTSTSSPSFLHSHYTPSSTSFHTNPVYSMKQEQLPSNQIPQIDGFNNVNNFTDNERQNHNLNSSGAHRRSSSCSLLEDVFEEAEALASGGRGRPPKRRQLTASLPNHNNNTNNNDNFFSVSFGHYDSSDNLCSLQDLKSKEEESLQMNTMQEDIAKLLDWGSDSGEISNGQSSVVTDDNLVLDVHQLASLFPADSTAVVAATNDQHNKNNNNNCSWDDMQGIR

SEQ ID NO: 2557 - DNA, 1072 bp, Arabidopsis thaliana
  misc_feature (46)..(46): n is a, c, g, or t
  misc_feature (61)..(61): n is a, c, g, or t
  misc_feature (63)..(63): n is a, c, g, or t
aagtagagaataataatcacatcaagattgtttataaccctccccntaatcaccttcttantnaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcatttttttaaaaaaaaaaaaaaaa

SEQ ID NO: 2558 - protein, 271 aa, Arabidopsis thaliana
MHRRAAIQESDDEEDETYNDVVPESPSSCEDSKISKPTPKKRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 2559 - DNA, 1166 bp, Arabidopsis thaliana
aacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 2560 - protein, 287 aa, Arabidopsis thaliana
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 2561 - DNA, 2793 bp, Arabidopsis thaliana
atggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagtaaggattttgtgagcagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaa

SEQ ID NO: 2562 - protein, 930 aa, Arabidopsis thaliana
MDSTNGNGADLESANGANGSGVTEALPPPPPVIPPNVEPVRVKTELAEKKGPVRVPMARKGFGTRGQKIPLLTNHFKVDVANLQGHFFHYSVALFYDDGRPVEQKGVGRKILDKVHQTYHSDLDGKEFAYDGEKTLFTYGALPSNKMDFSVVLEEVSATSKDFVSRANGNGSPNGNESPSDGDRKRLRRPNRSKNFRVEISYAAKIPLQALANAMRGQESENSQEAIRVLDIILRQHAARQGCLLVRQSFFHNDPTNCEPVGGNILGCRGFHSSFRTTQGGMSLNMDVTTTMIIKPGPVVDFLIANQNARDPYSIDWSKAKRTLKNLRVKVSPSGQEFKITGLSDKPCREQTFELKKRNPNENGEFETTEVTVADYFRDTRHIDLQYSADLPCINVGKPKRPTYIPLELCALVPLQRYTKALTTFQRSALVEKSRQKPQERMTVLSKALKVSNYDAEPLLRSCGISISSNFTQVEGRVLPAPKLKMGCGSETFPRNGRWNFNNKEFVEPTKIQRWVVVNFSARCNVRQVVDDLIKIGGSKGIEIASPFQVFEEGNQFRRAPPMIRVENMFKDIQSKLPGVPQFILCVLPDKKNSDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLVKKNGTEDDGIIKELLVDFYTSSNKRKPEHIIIFRDGVSESQFNQVLNIELDQIIEACKLLDANWNPKFLLLVAQKNHHTKFFQPTSPENVPPGTIIDNKICHPKNNDFYLCAHAGMIGTTRPTHYHVLYDEIGFSADELQELVHSLSYVYQRSTSAISVVAPICYAHLAAAQLGTFMKFEDQSETSSSHGGITAPGPISVAQLPRLKDNVANSMFFC

SEQ ID NO: 2563 - DNA, 978 bp, Arabidopsis thaliana
atggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaa

SEQ ID NO: 2564 - protein, 325 aa, Arabidopsis thaliana
MGRSPCCDENGLKKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLIAAANFNSLLNLNQNVQLDATTLAKAQLLHTMIQVLSTNNNTTNPSFSSSTMQNSNTNLFGQASYLENQNLFGQSQNFSHILEDENLMVKTQIIDNPLDSFSSPIQPGFQDDHNSLPLLVPASPEESKETQRMIKNKDIVDYHHHDASNPSSSNSTFTQDHHHPWCDTIDDGASDSFWKEIIE

SEQ ID NO: 2565 - DNA, 912 bp, Arabidopsis thaliana
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 2566 - protein, 268 aa, Arabidopsis thaliana
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 2567 - DNA, 800 bp, Arabidopsis thaliana
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 2568 - protein, 238 aa, Arabidopsis thaliana
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 2569 - DNA, 990 bp, Arabidopsis thaliana
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 2570 - protein, 329 aa, Arabidopsis thaliana
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 2571 - DNA, 849 bp, Arabidopsis thaliana
atgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaa

SEQ ID NO: 2572 - protein, 282 aa, Arabidopsis thaliana
MGRSPCCDKNGVKKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVRSGIDPVTHSPRLDLLDLSSLLSALFNQPNFSAVATHASSLLNPDVLRLASLLLPLQNPNPVYPSNLDQNLQTPNTSSESSQPQAETSTVPTNYETSSLEPMNARLDDVGLADVLPPLSESFDLDSLMSTPMSSPRQNSIEAETNSSTFFDFGIPEDFILDDFMF

SEQ ID NO: 2573 - DNA, 1081 bp, Arabidopsis thaliana
aaaaatatgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctggtcggaccgataacgagatcaagaatttctggaactcaacaataaagaaaaggctaaagaagatgtccgatacctccaacttaatcaacaactcatcctcatcacccaacacagcaagcgattcctcttctaattccgcatcttctttggatattaaagacattataggaagcttcatgtccttacaagaacaaggcttcgtcaacccttccttgacccacatacaaaccaacaatccatttccaacgggaaacatgatcagccacccgtgcaatgacgattttaccccttatgtagatggtatctatggagtaaacgcaggggtacaaggggaactctacttcccacctttggaatgtgaagaaggtgattggtacaatgcaaatataaacaaccacttagacgagttgaacactaatggatccggaaacgcacctgagggtatgagaccagtggaagaattttgggaccttgaccagttgatgaacactgaggttccttcgttttacttcaacttcaaacaaagcatatgaatatttttacgtcatcttattcttttttctattgcggtttatactcaagattcttagccacacacacataaatgcaaatatatatacattgttagagagtattttgtatttcgtataatcttttcgtactagggcttgagccttgaggtcccatgtaacgattagtcaatgtaaaacatatatcctataataaataaataaaagaaataataagcacataaaaaaaaaaaaa

SEQ ID NO: 2574 - protein, 280 aa, Arabidopsis thaliana
MRKPEVAIAASTHQVKKMKKGLWSPEEDSKLMQYMLSNGQGCWSDVAKNAGLQRCGKSCRLRWINYLRPDLKRGAFSPQEEDLIIRFHSILGNRWSQIAARLPGRTDNEIKNFWNSTIKKRLKKMSDTSNLINNSSSSPNTASDSSSNSASSLDIKDIIGSFMSLQEQGFVNPSLTHIQTNNPFPTGNMISHPCNDDFTPYVDGIYGVNAGVQGELYFPPLECEEGDWYNANINNHLDELNTNGSGNAPEGMRPVEEFWDLDQLMNTEVPSFYFNFKQSI

SEQ ID NO: 2575 - DNA, 1020 bp, Arabidopsis thaliana
gaagatcataaagatcaaaaggagagaggtattaaaaaatgatgtgtagtcgaggccattggagacctgcagaagacgagaagctaagagaactcgtcgagcaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgcctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagtccttgaccggaaagatcgggttcagaaatagtactactccaatacaagaaggagcaatagaccaaactaaacgaccgatggagttctacaattttctccaagtaaacacggattcgaagatacacgaattgatagataattcaagaaaagacgaagaagaagatgtcgatcaaaacaaccgaattcgtaacgagaattgtgttccatttttcgactttttgtctgttggaaactctgcctctcagggtttatgttaatttgtccgtaccacatgtactataaggtggaccatatgttaactaaagataatgtagaaagtactaatcaattagagctcctgtttgagccaaatgtgaaaattagttaagacatcccaaacattttcttgtataacacatataaggttgtacttttatcaggtctaattttctatttttattttaaggatgtttaatcagacccataaccattcgataaaaaaaaaaaaaa

SEQ ID NO: 2576 - protein, 249 aa, Arabidopsis thaliana
MMCSRGHWRPAEDEKLRELVEQFGPHNWNAIAQKLSGRSGKSCRLRWFNQLDPRINRNPFTEEEEERLLAPHRIHGNRWSVIARFFPGRTDNAVKNHWHVIMARRGRERSKLRPRGLGHDGTVAATGMIGNYKDCDKERRLATTTAINFPYQFSHINHFQVLKESLTGKIGFRNSTTPIQEGAIDQTKRPMEFYNFLQVNTDSKIHELIDNSRKDEEEDVDQNNRIRNENCVPFFDFLSVGNSASQGLC

SEQ ID NO: 2577 - DNA, 1041 bp, Arabidopsis thaliana
gttcttgtattggtttggatcggtatacttagttgattacgtaattaaatagatcggcgtgaagaagaaaaatgatcatgtgcagccgaggccattggagaccagctgaagacgagaagctcaaggatcttgtcgaacaatacggtcctcacaattggaacgccattgctctcaagcttcctggtcgctctggtaagagttgtagattgagatggtttaatcaattggatccaaggatcaaccgaaaccctttcacggaagaagaagaagaaagacttttagcggctcatcggatccatgggaacagatggtccatcatcgcaaggcttttccctggaagaactgataacgccgtcaagaaccattggcacgtcatcatggctcgtcgcacacgccaaacctctaagcctcgtcttcttccctcgacgacttcgtcttcttctttaatggcgagtgaacaaatcatgatgagttctggtggttataatcataattatagttccgatgatcggaagaaaatatttccagcagactttataaatttcccttacaaattctctcatatcaatcatcttcacttcctaaaggagtttttccccggaaagatcgctttaagtcacaaagcaaatcagagtaagaagcctatggagttctacaattttctacaagtaaacacagattcaaacaagagcgagattatagatcaagattcaggtcaaagcaaacgcagtgactcggacaccaaacatgaaagtcatgttccattcttcgactttttatccgttggaaactctgcctcctaggattagtttttttgcagtaactcctaaatttctagattaactatttagtccgtatacgtacgagattatctaggtcgttagcatgtatgcttgatgtgtataatcactaactagtgagctattacctgcgaaaattgtaagaaaaatacataatgttgatgtatcacacattctcaatgtctgtaaaatttccatcgagttgttaactatcaaagttatccgtttgaaaaaaaaaaaa

SEQ ID NO: 2578 - protein, 243 aa, Arabidopsis thaliana
MIMCSRGHWRPAEDEKLKDLVEQYGPHNWNAIALKLPGRSGKSCRLRWFNQLDPRINRNPFTEEEEERLLAAHRIHGNRWSIIARLFPGRTDNAVKNHWHVIMARRTRQTSKPRLLPSTTSSSSLMASEQIMMSSGGYNHNYSSDDRKKIFPADFINFPYKFSHINHLHFLKEFFPGKIALSHKANQSKKPMEFYNFLQVNTDSNKSEIIDQDSGQSKRSDSDTKHESHVPFFDFLSVGNSAS

SEQ ID NO: 2579 - DNA, 880 bp, Arabidopsis thaliana
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 2580 - protein, 250 aa, Arabidopsis thaliana
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 2581 - DNA, 1161 bp, Arabidopsis thaliana
aattcaatcactatatttttttaaaaacatttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatcattgtatttgttatatagattttgttacatatccaaaatccaaaatactatagttttaaaataaaaaaaaaaaaaaaaaa

SEQ ID NO: 2582 - protein, 324 aa, Arabidopsis thaliana
MGRSPCCEKKNGLKKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLKMGIDPVTHTPRLDLLDISSILSSSIYNSSHHHHHHHQQHMNMSRLMMSDGNHQPLVNPEILKLATSLFSNQNHPNNTHENNTVNQTEVNQYQTGYNMPGNEELQSWFPIMDQFTNFQDLMPMKTTVQNSLSYDDDCSKSNFVLEPYYSDFASVLTTPSSSPTPLNSSSSTYINSSTCSTEDEKESYYSDNITNYSFDVNGFLQFQ

SEQ ID NO: 2583 - DNA, 1274 bp, Arabidopsis thaliana
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 2584 - protein, 269 aa, Arabidopsis thaliana
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 2585 - DNA, 1630 bp, Arabidopsis thaliana
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 2586 - protein, 433 aa, Arabidopsis thaliana
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 2587 - DNA, 1001 bp, Arabidopsis thaliana
gcgcgattaaaaactctcaacttttctctcaaatttctgatcctttgatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgtgatttttttcgttacaaccatagtttcattttcatttttttagttacaaatttttaattgttctgatttggattgaaa

SEQ ID NO: 2588 - protein, 273 aa, Arabidopsis thaliana
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 2589 - DNA, 1047 bp, Arabidopsis thaliana
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 2590 - protein, 348 aa, Arabidopsis thaliana
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 2591 - DNA, 1257 bp, Arabidopsis thaliana
atgggagatagaaacaacgacggtgatcagaaaatggaggatgtattgttgcccggatttaggtttcatccaaccgacgaagagctcgtaagcttctacctgaagcggaaggttcaacacaaccctctctccattgagctcataagacaactcgatatctacaaatatgacccctgggatcttccaaagtttgcgatgacgggtgaaaaagaatggtacttttattgtccaagggacaggaagtataggaacagctcgaggccaaaccgagtgaccggagctggtttttggaaagccacgggaacggaccggccgatatactcgtcagaaggaaacaaatgcataggtttaaagaagtccttagtgttctacaaaggaagagcagcgaaaggagttaagactgattggatgatgcatgagtttcgtttgccttctctctccgaaccatctcctccttctaagagattcttcgactctcctgtctctcccaacgattcatgggctatatgcagaatcttcaaaaagaccaacacaacgaccctaagagctctctctcactcttttgtttcctcgttaccaccagaaacaagcaccgacacaatgtctaaccaaaagcaatcaaacacataccatttttcttcagacaagatcctcaaacctagctctcacttccagtttcaccatgagaatatgaacactcccaaaactagtaatagtacaactccatccgttcccactataagtcccttctcttacttggatttcacttcatacgacaaacccaccaacgttttcaatccggtttcatgtttagaccaacaatacctcacaaatctctttcttgccacacaagaaacacaacctcagtttcccaggctcccctcgtcaaatgaaatcccatcgtttctgctaaacacgtcttcagattcgaccttcttgggagaattcacgagccatatcgacctcagcgcagtgttggcccaagagcaatgtcccccgcttgtaagcctaccacaggagtatcaagagacgggattcgaaggaaatggtataatgaagaacatgcgtggttccaatgaagatcatcttggtgatcattgcgacacacttcggtttgatgatttcacttcaacaattaatgagaaccatcgtcatcatcaagacctgaaacagaacatgacattgctggagagttattattcttctttatcgtccatcaatagcgatttgccagcttgtttctccagtacaacctga

SEQ ID NO: 2592 - protein, 418 aa, Arabidopsis thaliana
MGDRNNDGDQKMEDVLLPGFRFHPTDEELVSFYLKRKVQHNPLSIELIRQLDIYKYDPWDLPKFAMTGEKEWYFYCPRDRKYRNSSRPNRVTGAGFWKATGTDRPIYSSEGNKCIGLKKSLVFYKGRAAKGVKTDWMMHEFRLPSLSEPSPPSKRFFDSPVSPNDSWAICRIFKKTNTTTLRALSHSFVSSLPPETSTDTMSNQKQSNTYHFSSDKILKPSSHFQFHHENMNTPKTSNSTTPSVPTISPFSYLDFTSYDKPTNVFNPVSCLDQQYLTNLFLATQETQPQFPRLPSSNEIPSFLLNTSSDSTFLGEFTSHIDLSAVLAQEQCPPLVSLPQEYQETGFEGNGIMKNMRGSNEDHLGDHCDTLRFDDFTSTINENHRHHQDLKQNMTLLESYYSSLSSINSDLPACFSSTT

SEQ ID NO: 2593 - DNA, 1964 bp, Arabidopsis thaliana
tccttccacaaaacttttttaattttatctgaaaaattaaaacaaccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttctt

SEQ ID NO: 2594 - protein, 479 aa, Arabidopsis thaliana
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 2595 - DNA, 1017 bp, Arabidopsis thaliana
cagctttaacactactctctctctctctcaaatgggaaaacaaatcaacatagagagtagtgctactcatcatcaagacaatattgtttccgttataacagccacgatatcctcctcctccgtcgtaacgtcttcgtcagactcttggtctacctccaaaagatcgttagtgcaagacaatgactccggagggaaacggcggaagagcaacgttagtgatgataacaagaatccgacgtcgtatagaggagtgaggatgaggagttggggaaaatgggtgtcggagattagagagccgaggaagaaatcaagaatatggcttggcacttatccaacggcagagatggcagctcgtgctcatgatgtggcggctttagctattaaaggcaactccggttttcttaatttccctgaattatccggtttgcttcctcgtccggttagctgctctcctaaggatatacaagctgcagctaccaaagccgccgaagcaaccacgtggcacaaaccggttatcgataagaaattagctgatgagctaagccactctgagttgttgtctaccgctcagtcttcgacttctagtagtttcgtgttttcttcggacacgtcggagacttctagtacggacaaggaaagcaacgaagagacggtgtttgatttgccggaccttttcacggacgggcttatgaacccaaacgatgcgttttgtttatgcaacggcacctttacgtggcagctttacggagaggaggatgtagggttcaggtttgaagagccgtttaattggcaaaatgactaaaccgccctccacttgcttactgtaattactaacatataattttcttgataaagaacatatatttccattacggtattaactaatcttttctatccttttctcttttcttgtttctacatctgagtatattgtcactatgtgaaaaaattgatctcgttttgaatatttacttttcaaaattgaagtaacgcaagtgattgataaaaaaaaaaaaa

SEQ ID NO: 2596 - protein, 256 aa, Arabidopsis thaliana
MGKQINIESSATHHQDNIVSVITATISSSSVVTSSSDSWSTSKRSLVQDNDSGGKRRKSNVSDDNKNPTSYRGVRMRSWGKWVSEIREPRKKSRIWLGTYPTAEMAARAHDVAALAIKGNSGFLNFPELSGLLPRPVSCSPKDIQAAATKAAEATTWHKPVIDKKLADELSHSELLSTAQSSTSSSFVFSSDTSETSSTDKESNEETVFDLPDLFTDGLMNPNDAFCLCNGTFTWQLYGEEDVGFRFEEPFNWQND

SEQ ID NO: 2597 - DNA, 2008 bp, Arabidopsis thaliana
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 2598 - protein, 557 aa, Arabidopsis thaliana
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 2599 - DNA, 979 bp, Arabidopsis thaliana
ggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 2600 - protein, 301 aa, Arabidopsis thaliana
MEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 2601 - DNA, 845 bp, Arabidopsis thaliana
aattttatttccttctctcaaatcttcccaccaaaaattaactctttcgttcacactaagtcccttttaaaagaaaatatcccaattaatggaacgtgacgactgccggagatttcaggactcgccggcgcagacgacggagagaagagtgaaatataaaccaaagaagaaaagagccaaagatgatgatgatgagaaagttgtttcgaagcatccaaattttcgaggtgtcagaatgagacaatggggaaaatgggtgtccgaaatcagagagccaaaaaagaaatcaagaatctggctcggtactttctccacggcggagatggcggcgcgtgctcacgacgtggcagctttagccatcaaaggcggttctgcacatctcaacttcccggagctcgcttatcacctccctagaccagctagtgccgaccctaaagacatccaagctgccgccgccgcagctgcagccgctgtggccattgacatggatgtagagacgtcttcgccgtcgccatctcccacagttacggaaacgtcatctccggctatgatagcactctccgacgacgcgttctccgatcttcctgatctcttgctcaacgtgaaccataacatcgatggcttctgggactcttttccctatgaagaacccttcctctctcaaagttactagaaactcaaaactatgtcgtttttgtatgtatttttgtcatgtgaccattttttgacgtcgaaaatcacccggataatccaaattgtatgatttattaatggttgatgattttctttgtgtggaacaatgtgtatgatacgtaatcaaaagttcaaaaaaaaaataaaaaaaa

SEQ ID NO: 2602 - protein, 194 aa, Arabidopsis thaliana
MERDDCRRFQDSPAQTTERRVKYKPKKKRAKDDDDEKVVSKHPNFRGVRMRQWGKWVSEIREPKKKSRIWLGTFSTAEMAARAHDVAALAIKGGSAHLNFPELAYHLPRPASADPKDIQAAAAAAAAAVAIDMDVETSSPSPSPTVTETSSPAMIALSDDAFSDLPDLLLNVNHNIDGFWDSFPYEEPFLSQSY

SEQ ID NO: 2603 - DNA, 436 bp, Arabidopsis thaliana
tcgacctcgtttcctttcctcctctcttcctaccattagtacgttactggagctgatctcacgtatattttggatcgtaatcatggacggcgaagattttgccggaaaggcggctgctgaagccaagggattgaacccgggattaatcgtgctgcttgttgttggaggtccgcttcttgtgttcctaatcgccaactacgtgctttacgtttatgctcagaagaacctacctccaaggaagaagaagcccgtttccaaaaagaagctcaagcgggagaagctaaagcaaggagtccctgtccctggagaataaaagccagcttaagcttccttcacttgtgcctccttcaaagcggtttttgttcggttaccaaatttcacccttgcgggtttttttcttcctttacttctgtcatgaggattatctttgaggcct

SEQ ID NO: 2604 - protein, 76 aa, Arabidopsis thaliana
MDGEDFAGKAAAEAKGLNPGLIVLLVVGGPLLVFLIANYVLYVYAQKNLPPRKKKPVSKKKLKREKLKQGVPVPGE

SEQ ID NO: 2605 - DNA, 1674 bp, Arabidopsis thaliana
aggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgagtatccttgttagaaacaaacttactgttgcaaaactctcttcaaaaaagtttcactttgctttccca

SEQ ID NO: 2606 - protein, 404 aa, Arabidopsis thaliana
MEEREGTNINNNITSSFGLKQQHEAAASDGGYSMDPPPRPENPNPFLVPPTTVPAAATVAAAVTENAATPFSLTMPTENTSAEQLKKKRGRPRKYNPDGTLVVTLSPMPISSSVPLTSEFPPRKRGRGRGKSNRWLKKSQMFQFDRSPVDTNLAGVGTADFVGANFTPHVLIVNAGEDVTMKIMTFSQQGSRAICILSANGPISNVTLRQSMTSGGTLTYEGRFEILSLTGSFMQNDSGGTRSRAGGMSVCLAGPDGRVFGGGLAGLFLAAGPVQVMVGTFIAGQEQSQLELAKERRLRFGAQPSSISFNISAEERKARFERLNKSVAIPAPTTSYTHVNTTNAVHSYYTNSVNHVKDPFSSIPVGGGGGGEVGEEEGEEDDDELEGEDEEFGGDSQSDNEIPS

SEQ ID NO: 2607 - DNA, 894 bp, Arabidopsis thaliana
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 2608 - protein, 297 aa, Arabidopsis thaliana
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 2609 - DNA, 861 bp, Arabidopsis thaliana
ccttatcactcaccaaaagtcgtcacataatatcactttcgagttatcaacatccgtacatgtcatccatagagccaaaagtaatgatggttggtgctaataagaaacaacgaaccgtccaagctagttcgaggaaaggttgtatgagaggaaaaggtggacccgataacgcgtcttgcacttacaaaggtgttagacaacgcacttggggcaaatgggtcgctgagatccgcgagcctaaccgaggagctcgtctttggctcggtaccttcgacacctcccgtgaagctgccttggcttatgactccgcagctcgtaagctctatgggcctgaggctcatctcaacctccctgagtccttaagaagttaccctaaaacggcgtcgtctccggcgtcccagactacaccaagcagcaacaccggtggaaaaagcagcagcgactctgagtcgccgtgttcatccaacgagatgtcatcatgtggaagagtgacagaggagatatcatgggagcatataaacgtggatttgccggtaatggatgattcttcaatatgggaagaagctacaatgtcgttaggatttccatgggttcatgaaggagataatgatatttctcggtttgatacttgtatttccggtggctattctaattgggattcctttcattccccactttgaggtgtcactagactctctttaattgttaagttatcatatacaaactacatatatatacaaatatagtcaccgtgaactaggatatatatgtaaataaacaccagttacatgtacttatatatgtgcacatctatatatgtggtttgtctgtatagtgtgaaagcagattcttaccatatca

SEQ ID NO: 2610 - protein, 206 aa, Arabidopsis thaliana
MSSIEPKVMMVGANKKQRTVQASSRKGCMRGKGGPDNASCTYKGVRQRTWGKWVAEIREPNRGARLWLGTFDTSREAALAYDSAARKLYGPEAHLNLPESLRSYPKTASSPASQTTPSSNTGGKSSSDSESPCSSNEMSSCGRVTEEISWEHINVDLPVMDDSSIWEEATMSLGFPWVHEGDNDISRFDTCISGGYSNWDSFHSPL

SEQ ID NO: 2611 - DNA, 1306 bp, Arabidopsis thaliana
aaagtatcatctcatagattccatcttttctctattacatggagaagaaaaaagaagaggatcatcatcatcaacaacaacaacaacaacaaaaggagatcaagaacacagagacaaagatcgagcaagaacaagaacaagaacaaaaacaagaaatctctcaagcatcatcatcatcaaacatggcgaatctagttacgtcatcagatcatcatccgttggagctagctggaaatctctcaagcatcttcgatacttcatctttaccttttccttattcttatttcgaagatcactcttctaataatcctaattctttcctagacttgctccgacaagatcatcagtttgcttcttcctctaattcctcttctttttcattcgatgcctttcctctccccaataacaacaacaacacctctttttttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgagc

SEQ ID NO: 2612 - protein, 399 aa, Arabidopsis thaliana
MEKKKEEDHHHQQQQQQQKEIKNTETKIEQEQEQEQKQEISQASSSSNMANLVTSSDHHPLELAGNLSSIFDTSSLPFPYSYFEDHSSNNPNSFLDLLRQDHQFASSSNSSSFSFDAFPLPNNNNNTSFFTDLPLPQAESSEVVNTTPTSPNSTSVSSSSNEAANDNNSGKEVTVKDQEEGDQQQEQKGTKPQLKAKKKNQKKAREARFAFLTKSDIDNLDDGYRWRKYGQKAVKNSPYPRSYYRCTTVGCGVKKRVERSSDDPSIVMTTYEGQHTHPFPMTPRGHIGMLTSPILDHGATTASSSSFSIPQPRYLLTQHHQPYNMYNNNSLSMINRRSSDGTFVNPGPSSSFPGFGYDMSQASTSTSSSIRDHGLLQDILPSQIRSDTINTQTNEENKK

SEQ ID NO: 2613 - DNA, 1260 bp, Arabidopsis thaliana
gaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgtttagtgaagttttgttaccggcgacggcgaggattaaaaaaaaacggcgatttattttttgaatgaagatttgttaaata

SEQ ID NO: 2614 - protein, 287 aa, Arabidopsis thaliana
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 2615 - DNA, 1281 bp, Arabidopsis thaliana
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 2616 - protein, 298 aa, Arabidopsis thaliana
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 2617 - DNA, 1293 bp, Arabidopsis thaliana
atgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatgtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaa

SEQ ID NO: 2618 - protein, 430 aa, Arabidopsis thaliana
MGTRAERKEDFVGGFGFGVVENSHKDVMVLPHHHYYPSYSSPSSSSLCYCSAGVSDPMFSVSSNQAYTSSHSGMFTPAGSGSAAVTVADPFFSLSSSGEMRRSMNEDAGAAFSEAQWHELERQRNIYKYMMASVPVPPELLTPFPKNHQSNTNPDVTVAVATGGSLQLGIASSASNNTADLEPWRCKRTDGKKWRCSRNVIPDQKYCERHTHKSRPRSRKHVESSHQSSHHNDIRTAKNDTSQLVRTYPQFYGQPISQIPVLSTLPSASSPYDHHRGLRWFTKEDDAIGTLNPETQEAVQLKVGSSRELKRGFDYDLNFRQKEPIVDQSFGALQGLLSLNQTPQHNQETRQFVVEGKQDEAMGSSLTLSMAGGGMEETEGTNQHQWVSHEGPSWLYSTTPGGPLAEALCLGVSNNPSSSTTTSSCSRSSS

SEQ ID NO: 2619 - DNA, 1148 bp, Arabidopsis thaliana
aatcccctatccttcgcaagacccttcctctatataaggaagttcatttcatttttttttgacacgctgacaagctgactctagcatatctggcaccggcgaccagtccttctttggtgcaaagatcccaaaaaatcaaaatcgaaagagagaataaatcaaaaggaagaatctttatctgctttctctcgatgaggatccggaaacgacaagtgcctcttcctttatcgtctctattaccagttcctctatcagatctctactttaaccgctcaccgacggccaccgcgagatactttcgcggtggttataaagacggcggtgatgattttggttctcttcagctttcgcttccgccgccgtcgcagatttctgatcggcttattcaaagagatttgataaagaagaaggaggaggtcaaggctttggatgatgataatggtgatgtagacgtcaagagtcgtactgatgcatcgggcagcaagaatgttaatccccgaggagaatccgtctcttcaatacaagttgtcgagaagaatgaaaaggttgtgtctttgaggaagagaagaggctttatcaactttgaggattacgaagatgaggaagatgaagaagctagtggcggtggaggccgtattaataaagggaaaaagaaagcgaaaaagagcggtggtgggttagaggaaggatcacggtgcagccgtgttaacggtagaggatggagatgttgtcagcaaacgcttgttggttattctctttgtgagcatcatctcggtaaaggaagggtaaggagcatgaacaagagtggtggtggtcgtggcggcgagaaaaaggcggtggtggtggaagtgaagaagaagagagtaaagcttggcatggtaaaggcacgttcaataagtagtttgcttggacaaaccagcactagtggtggtactagtggtgatgttgatcagggtgagataagtgcacctgctgatcagttcgctgcatgtgataagtaggtctgttgatcagcatttgcatgtatatggatatgtgtatgtttatgtacatgatgataatgggcatagcgcggccgctctagacaggcctggaaccggatcctctagctagagctttcgttagtatcatcgggtttagacaacgtt

SEQ ID NO: 2620 - protein, 269 aa, Arabidopsis thaliana
MRIRKRQVPLPLSSLLPVPLSDLYFNRSPTATARYFRGGYKDGGDDFGSLQLSLPPPSQISDRLIQRDLIKKKEEVKALDDDNGDVDVKSRTDASGSKNVNPRGESVSSIQVVEKNEKVVSLRKRRGFINFEDYEDEEDEEASGGGGRINKGKKKAKKSGGGLEEGSRCSRVNGRGWRCCQQTLVGYSLCEHHLGKGRVRSMNKSGGGRGGEKKAVVVEVKKKRVKLGMVKARSISSLLGQTSTSGGTSGDVDQGEISAPADQFAACDK

SEQ ID NO: 2621 - DNA, 1177 bp, Arabidopsis thaliana
aaaaaccctaaccctaattctctcaagacaactcaaaggtctctccttttttaggtttattatcacttccgtataatcgccatgtcttctctaccatggaaaaaaccaaaatcgagtcgaatcttaagattcatttctgagtttcaacaatcaccgttcgttgaaactggctttccaacttctctgatcgatctcttcttcaagaatcgcgatcgtctaaaaaaatctccatctaaacgcttccaacgaatcgaacgccagattcgaaccgctccaaacgcttcttcgttgagtaatcaagatacgatttttgaaaagccctcgaggattaaaaccgttcgaagtaaggtcgagaaagttaattgcgttaaaggtaaatcagcggcgttgaagaagaacgcgattaaaaatagcgttttcggcggtagcggtgaggtcgttttgatggcgtttaaggttttgatagtagcgttgctcgccttgagcacgaagaagaagctcactttaggaatcactctctctgccttcgctcttctcttaacagagctcgtggcggcgcgtgttttcacgcgctctaataacaccgacaaagacaaaaacgcgattgcccgcgagaaaatcgaaacttttgatgaaactcgagttcccaaagcgattccatgtcctgaggaaacagagcatgtagtatctgaaacagaggtttcgaagttgaaaggtttaacgatacgtgatctgttgtcaaaggacgagaaatcaacaagtaaaagttggagactaaaatcgaagattgtgaagaagttgaggagttacaataagaaggataagaagacgatgaagatcaaagaagagtctttgattgaagtctcgagtttggttttagaagataaaccaaagaaaattgagtctgagagagacgaagaagaaacgttgaatcctccagtggttggatcaaacctgaatgggattgttctgatcgtgattgtgctaaccggtttgttatgtgggaaggtcttagctattgttctgacactatcatgtttggttcttagattaggagcagtcaaaaaagttaatctttgcatataattttttttgtattttttaacatgcttgcatgtgaaactgtaaatttttctcattcatatgaaggagattggattgaatgttgaatactaaa

SEQ ID NO: 2622 - protein, 334 aa, Arabidopsis thaliana
MSSLPWKKPKSSRILRFISEFQQSPFVETGFPTSLIDLFFKNRDRLKKSPSKRFQRIERQIRTAPNASSLSNQDTIFEKPSRIKTVRSKVEKVNCVKGKSAALKKNAIKNSVFGGSGEVVLMAFKVLIVALLALSTKKKLTLGITLSAFALLLTELVAARVFTRSNNTDKDKNAIAREKIETFDETRVPKAIPCPEETEHVVSETEVSKLKGLTIRDLLSKDEKSTSKSWRLKSKIVKKLRSYNKKDKKTMKIKEESLIEVSSLVLEDKPKKIESERDEEETLNPPVVGSNLNGIVLIVIVLTGLLCGKVLAIVLTLSCLVLRLGAVKKVNLCI

SEQ ID NO: 2623 - DNA, 983 bp, Arabidopsis thaliana
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgct

SEQ ID NO: 2624 - protein, 292 aa, Arabidopsis thaliana
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 2625 - DNA, 1272 bp, Arabidopsis thaliana
atgatgaaaggtctgattgggtatagatttagtccgacgggagaggaagtgatcaaccattacctaaagaacaaacttctgggtaagtattggctcgttgatgaagctattagcgagatcaacatcttgagtcacaaacccagcaaggatttgcctaagttagctaggatccaatcggaagatcttgaatggtatttcttctctccgattgagtacacgaacccgaataagatgaaaatgaagaggacgacaggttctgggttttggaaacctactggtgttgatcgggaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaccggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgaggcatgttgatcgagggacggttgaatatttgtttgccaatgaagaaaacatggatggtttgtctatgaatgacttgagaatcccaatgatcgtccaacaagaggatctctctgagtgggagggatttaacgcagacacctttttcagcgacaacaacaataactataaccttaacgtgcatcatcaactaacgccttacggcgatggctatttgaatgcattttcgggttataacgaagggaatcctcccgatcacgaattagtgatgcaagagaaccgcaacgatcacatgccaaggaaacctgtgacagggaccattgattatagcagcgatagtggcagtgatgctggatccatatctacaacggtgaaacaagaaatcccaagagctgttgatgcacccatgaacaatgagtcatctttggtgaaaacagagaagaaaggcttgtttattgtagaggacgcaatggagagaaaccgcaagaaaccacgatttatctatctcatgaagatgatcataggcaacatcatatcggttttactacccgtcaaaagattgatcccggtgaagaagttatga

SEQ ID NO: 2626 - protein, 423 aa, Arabidopsis thaliana
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTVKQEIPRAVDAPMNNESSLVKTEKKGLFIVEDAMERNRKKPRFIYLMKMIIGNIISVLLPVKRLIPVKKL

SEQ ID NO: 2627 - DNA, 1034 bp, Arabidopsis thaliana
  misc_feature (1029)..(1029): n is a, c, g, or t
cgtcgaccttcactcaaaccctaatcccgggaacccgggaattttgatcattttgtttcttttcgatctgtttctattttaaaaagatgatgaaagatccgactgggtatagatttagtccgacgggagaggaagtgataaaccattacctaaagaacaaaattctgggtaagacttggctcgttgatgaagccattagcgagatcaacatcttgaatcacaaacccagcaaggatttgcctaagttagctaggatccaatcggaagatcttgagtggtactttttctctccgattgagtacacgaacccgaataagatgaaaatgaagaggacgacaggttctgggttttggaaacctagtggtgttgatcggaaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaacggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgagacatgttgatcgagagccggttgaatatttgtttgccaatgaagaaaacatggatggtttgtctattatgaatgacttgacaatcccaatgatcgcccaacaagaggatctcattctctctgagtgggagggatttatcgcagccacctttttcagcgacaacaacaataacaataaccttaacgtgcatcaactaacgtctttcttaccgggatgattatcagaatgcattttgggttacaacggagcgnccgct

SEQ ID NO: 2628 - protein, 302 aa, Arabidopsis thaliana
MMKDPTGYRFSPTGEEVINHYLKNKILGKTWLVDEAISEINILNHKPSKDLPKLARIQSEDLEWYFFSPIEYTNPNKMKMKRTTGSGFWKPSGVDRKIRDKRGNGVVIGIKKTLVYHEGKSPHGVRTPWVMHEYHITCLPHHKRKYVVCQVKYKGEAAEISYEPSPSLVSDSHTVIAINGEPEPELQVEQPGKENLLGMSVDDLIEPMNQQEEPQGPHLAPNDDEFIRGLRHVDREPVEYLFANEENMDGLSIMNDLTIPMIAQQEDLILSEWEGFIAATFFSDNNNNNNLNVHQLTSFLPG

SEQ ID NO: 2629 - DNA, 645 bp, Arabidopsis thaliana
atgaagagaacacatttggcaagttttagtaacagagacaaaacccaagaagaagaaggagaagacggtaatggtgacaacagagtcatcatgaatcactacaagaattacgaagctgggctgatcccatggcctcccaagaattacacttgcagcttctgcaggagagagttcagatctgctcaagcacttggaggccacatgaatgttcatagaagagacagagcaaaactcaggcagatcccttcttggctcttcgaacctcaccaccacacacctattgcaaaccctaaccctaattttagctcttcttcttcctcttcaacaacaacagctcatcttgagccttccctaaccaaccagagatccaaaaccactccttttccttctgcccggtttgatcttttggacagtactactagctatggaggtttgatgatggacagagagaagaacaagagcaatgtatgtagcagagagatcaagaaaagtgccatcgatgcatgtcattcagtaagatgtgagataagccgtggggatctgatgaataagaaagatgatcaagtcatggggttggagcttgggatgagtttgaggaatcccaaccaagttcttgatttggagcttcgactaggctacctctaa

SEQ ID NO: 2630 - protein, 214 aa, Arabidopsis thaliana
MKRTHLASFSNRDKTQEEEGEDGNGDNRVIMNHYKNYEAGLIPWPPKNYTCSFCRREFRSAQALGGHMNVHRRDRAKLRQIPSWLFEPHHHTPIANPNPNFSSSSSSSTTTAHLEPSLTNQRSKTTPFPSARFDLLDSTTSYGGLMMDREKNKSNVCSREIKKSAIDACHSVRCEISRGDLMNKKDDQVMGLELGMSLRNPNQVLDLELRLGYL

SEQ ID NO: 2631 - DNA, 606 bp, Arabidopsis thaliana
atgttgtcctcggactcgaattacgctagtgatattagcgacgatgcctccgccaccggatcgatagagaatcctatatacaaatgcaagtattgtcctaggaagttcgataaaacacaagcattaggtggtcatcaaaatgcacacagaaaggagagagaggtcgaaaaacaacaaaaagcatttttggcgcatttgaaccgaccagaaccagatctttacgcgtactcgtattcgtatcatcattcatttcctaaccaatacgcactcccaccgggatttgaacagcctcagtacaaagttgatagatcatacaagatgtccatggtctacaaccaatatgtgggatcctcaagctctagctttgcaggactacaaagtgacccaagtcaaggaatgaaccaggattggacctttaccgggatcccattcctaccccaatctcaacctcaaccactatcgtcaccaatatgtttggatctttgccttggcattggtagctcccaaacccaaccacaacctcaagaaccaaatgatgcaacagaagagatggatgctgagaaagaaaatgatggttcttccctttctctctcactcaaactgtga

SEQ ID NO: 2632 - protein, 201 aa, Arabidopsis thaliana
MLSSDSNYASDISDDASATGSIENPIYKCKYCPRKFDKTQALGGHQNAHRKEREVEKQQKAFLAHLNRPEPDLYAYSYSYHHSFPNQYALPPGFEQPQYKVDRSYKMSMVYNQYVGSSSSSFAGLQSDPSQGMNQDWTFTGIPFLPQSQPQPLSSPICLDLCLGIGSSQTQPQPQEPNDATEEMDAEKENDGSSLSLSLKL

SEQ ID NO: 2633 - DNA, 1020 bp, Arabidopsis thaliana
atggaacaagccgcgttgaagagcagcgtcaggaaagagatggctctcaaaacgacttctccggtttacgaagagtttcttgccgtcaccaccgctcaaaatggcttttccgtcgacgatttctctgtagacgacttgcttgacttgtcaaacgatgacgtttttgccgacgaagaaactgacctcaaggctcaacatgagatggtccgtgtttcctctgaggaacccaacgacgacggagacgctcttcgccggagcagcgatttctccggctgtgacgactttggttctctccctacaagcgaactctctcttccggcggatgatttagcgaaccttgagtggctctctcatttcgtggaggactccttcacggaatattcgggtccaaacctcaccggaaccccgactgagaaaccggcgtggttaacgggtgaccggaaacatcctgtgactgcagtcacggaagagacctgtttcaaatcccctgttccggctaaagcccgtagcaaacgtaaccgcaatggcctcaaggtctggtcgcttggttcgtcgtcctcctcgggtccttcctcgtccggttcgacctcctcctcctcttcgggtccttccagcccgtggttctccggcgctgagctgctcgagcctgtggtcacgtcagagaggccaccgtttcccaagaagcataagaaaaggtcagccgagtctgttttctccggtgagctgcagcagctgcaacctcagcgaaagtgcagccactgcggcgttcagaaaactccgcagtggagagccgggccaatgggagccaagaccctgtgcaatgcgtgcggtgtccggtacaagtcgggtaggttgctaccggaatacagacccgcttgtagcccgacattctcgagtgagctgcactcgaaccaccaccggaaagtcatagagatgaggcggaagaaggagccaaccagtgacaacgaaaccggtttaaaccagctggttcagtccccacaagctgtaccaagtttttga

SEQ ID NO: 2634 - protein, 339 aa, Arabidopsis thaliana
MEQAALKSSVRKEMALKTTSPVYEEFLAVTTAQNGFSVDDFSVDDLLDLSNDDVFADEETDLKAQHEMVRVSSEEPNDDGDALRRSSDFSGCDDFGSLPTSELSLPADDLANLEWLSHFVEDSFTEYSGPNLTGTPTEKPAWLTGDRKHPVTAVTEETCFKSPVPAKARSKRNRNGLKVWSLGSSSSSGPSSSGSTSSSSSGPSSPWFSGAELLEPVVTSERPPFPKKHKKRSAESVFSGELQQLQPQRKCSHCGVQKTPQWRAGPMGAKTLCNACGVRYKSGRLLPEYRPACSPTFSSELHSNHHRKVIEMRRKKEPTSDNETGLNQLVQSPQAVPSF

SEQ ID NO: 2635 - DNA, 1069 bp, Arabidopsis thaliana
aatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgagcaacaccaaaacttgttcttaagatgatggatgtgaagggacttaccatttcacatgtcaaaagccaccttcagatgtatagaggaggttcaaagctcactttggagaaaccagaagaaagctcatcatcttcaataagaagaagacaagacagtgaagaagattattatcttcatgacaacttgtctttacacacaaggaatgattgtcttttgggttttcactcttttcctctttcttcacattcttcatttagaggaggaggaggaggaagaacaaaagagcagcagacttcagagtctggtggttatgatgatgatgctgactttcttcacatcaagaagatgaacgatacgacgacgtttttgtcacatcatttccccaagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaa

SEQ ID NO: 2636 - protein, 256 aa, Arabidopsis thaliana
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVVSETSEAAVSTCSAPFVSKDCFGSSKIDLNLSISLLGS

SEQ ID NO: 2637 - DNA, 681 bp, Arabidopsis thaliana
atggatgatatagcggaacttgaatggttatcaaatttcgtagatgattcttctttcacgccgtattctgctccgacgaataaaccggtttggttaaccggaaatcggagacatcttgtacaaccggttaaagaggagacctgcttcaaatcccaacatccggccgtcaaaaccagacccaaacgagccagaaccggagtcagagtctggtctcatggttcgcagtcgttaaccgactcatcttcaagctctacaacatcttcgtcgtcctctcctcgtccttcaagccctctatggctcgccagcggtcagtttcttgatgagccaatgactaaaacacaaaagaagaagaaagtttggaaaaacgctggtcagacgcaaacgcaaacgcagacgcagacgcggcagtgtggtcattgtggagttcagaaaacgccgcagtggagagcaggaccattaggagcgaagacgttgtgtaatgcgtgtggtgtgcgttacaaatcgggtcggttactacccgaatatagacccgcttgtagcccaacattttcgagtgagcttcactcaaaccaccacagtaaagtcattgagatgcgtaggaagaaagagacttctgacggtgctgaagaaaccggtttgaaccagccggttcagacggttcaggttgtctcgagtttttga

SEQ ID NO: 2638 - protein, 226 aa, Arabidopsis thaliana
MDDIAELEWLSNFVDDSSFTPYSAPTNKPVWLTGNRRHLVQPVKEETCFKSQHPAVKTRPKRARTGVRVWSHGSQSLTDSSSSSTTSSSSSPRPSSPLWLASGQFLDEPMTKTQKKKKVWKNAGQTQTQTQTQTRQCGHCGVQKTPQWRAGPLGAKTLCNACGVRYKSGRLLPEYRPACSPTFSSELHSNHHSKVIEMRRKKETSDGAEETGLNQPVQTVQVVSSF

SEQ ID NO: 2639 - DNA, 1413 bp, Arabidopsis thaliana
atggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatga

SEQ ID NO: 2640 - protein, 470 aa, Arabidopsis thaliana
MGKQGPCYHCGVTSTPLWRNGPPEKPVLCNACGSRWRTKGSLVNYTPLHARAEGDETEIEDHRTQTVMIKGMSLNKKIPKRKPYQENFTVKRANLEFHTGFKRKALDEEASNRSSSGSVVSNSESCAQSNAWDSTFPCKRRTCVGRPKAASSVEKLTKDLYTILQEQQSSCLSGTSEEDLLFENETPMLLGHGSVLMRDPHSGAREEESEASSLLVESSKSSSVHSVKFGGKAMKQEQVKRSKSQVLGRHSSLLCSIDLKDVFNFDEFIENFTEEEQQKLMKLLPQVDSVDRPDSLRSMFESSQFKENLSLFQQLVADGVFETNSSYAKLEDIKTLAKLALSDPNKSHLLESYYMLKRREIEDCVTTTSRVSSLSPSNNNSLVTIERPCESLNQNFSETRGVMRSPKEVMKIRSKHTEENLENSVSSFKPVSCGGPLVFSYEDNDISDQDLLLDVPSNGSFPQAELLNMI

SEQ ID NO: 2641 - DNA, 420 bp, Arabidopsis thaliana
atgctagatcacagtgaaaaggtcttattggttgattcagaaaccatgaaaacaagagctgaagatatgatcgaacagaacaacactagtgttaacgacaagaagaagacttgtgctgattgtggaaccagtaaaactcctctttggcgtggtggtcctgttggtccaaagtcgttgtgtaacgcgtgtgggatcagaaacagaaagaagagaagaggaggaacagaagataataagaaattaaagaaatcgagttctggcggcggaaaccgtaaatttggtgaatcgttaaaacagagtttgatggatttggggataaggaagagatcaacggtggagaagcaacgacagaagcttggtgaagaagaacaagccgctgtgttactcatggctctttcttatggctctgtttacgcttag

SEQ ID NO: 2642 - protein, 139 aa, Arabidopsis thaliana
MLDHSEKVLLVDSETMKTRAEDMIEQNNTSVNDKKKTCADCGTSKTPLWRGGPVGPKSLCNACGIRNRKKRRGGTEDNKKLKKSSSGGGNRKFGESLKQSLMDLGIRKRSTVEKQRQKLGEEEQAAVLLMALSYGSVYA

SEQ ID NO: 2643 - DNA, 732 bp, Arabidopsis thaliana
atggaagggaacttcttcatcaggtctgatgctcaacgagcacatgacaatggcttcatagccaaacaaaaacctaatctcaccacggctccaacagcaggtcaagctaatgaaagtggctgttttgactgcaacatctgtttagacacagcccatgatccggtggtcactctctgcgggcaccttttctgctggccttgcatttacaagtggttacatgttcagttatcttctgtctccgttgatcagcaccagaacaattgccctgtttgtaaatccaacattactatcacctctttggttcctctctatggaagaggcatgtcttcgccttcttccacgtttggctccaagaaacaagacgcactgtccactgacataccccgcagacctgctccatcagccttacgcaatccgattacctcagcatcatctctgaacccaagcttgcaacatcaaactctgtctccttcatttcataatcatcagtattcccctcgtggcttcaccacaaccgaatcaaccgaccttgccaatgctgtaatgatgagtttcctctaccctgtgattggaatgtttggagacctggtctacaccaggatattcgggaccttcacaaacacaatagctcagccttaccaaagccagaggatgatgcagcgtgagaagtctcttaatcgggtatcgatattcttcctttgttgcatcatcctttgcctccttctcttctag

SEQ ID NO: 2644 - protein, 243 aa, Arabidopsis thaliana
MEGNFFIRSDAQRAHDNGFIAKQKPNLTTAPTAGQANESGCFDCNICLDTAHDPVVTLCGHLFCWPCIYKWLHVQLSSVSVDQHQNNCPVCKSNITITSLVPLYGRGMSSPSSTFGSKKQDALSTDIPRRPAPSALRNPITSASSLNPSLQHQTLSPSFHNHQYSPRGFTTTESTDLANAVMMSFLYPVIGMFGDLVYTRIFGTFTNTIAQPYQSQRMMQREKSLNRVSIFFLCCIILCLLLF

SEQ ID NO: 2645 - DNA, 1233 bp, Arabidopsis thaliana
atggccgaaactatgaaagatattacgatgaagaacgatgaatcacaggaagaagaaatccccgatcaatttctctgctgcgtttgcctggaacttctttacaagccaattgtgttatcttgtggtcatctatcatgtttttggtgcgtacataagtccatgaatggctttcgtgagtctcattgtccgatatgtagagacccgtatgttcactttccctctgtgtgccagaagctttattttctgttaaagaagatgtacccacttgctcataagaagagagaagaacaagttttaaaggaagagcaagaacgagaatgtttttctcctcagattgatcttgttttggatttgtctgtgtgtagtggagattctctcaatgtctctgataaacagaaggtggaagagtgttcgaatgcagcgaacttattatctagttcatcaagtagaggtgacattccatgtatccccaaaaatcaagaacccacagatgcaaaagctcttaatgttcatgaaaatgaattacttaaggataacaaagtcagtaagcagatttcgaaagatgatttgctctgttcagcatgtaaggagctgcttgtacgacccgtagttctcaattgcggacatgtgtattgtgaaggatgtgtagtagatatggctgaagaaagcgaaaagatcaaatgtcaagagtgtaatgtttgtgacccaagaggatttccaaaagtttgtttgattcttgaacagcttttggaggaaaactttcctgaagaatacaattcaagaagcagtaaggttcagaaaacgctcgcccataatagcaaaggaaatattcaaagctatctcaaagaaggcccgtccttatcaaacgacaataacaatgatgatccctggttggcaaaccctggatcaaatgttcactttggagctggttgtgattcttgtggggtgtatccaatcataggggatcgatacagatgcaaagactgcaaggaggaaattgggtatgacctttgcaaagactgttacgagactccttcgaaagttccagggagattcaaccagcaacacactcctgaccacaggcttgagcttgcacggtctcctcaggttctgatcaatttcaattctatcggtatccttctcggacccgttatctcaaatgaaggcatggatacagatgaaggcgaggaagggcctcctggttcttctaatgagtcatcaagcacagaatga

SEQ ID NO: 2646 - protein, 410 aa, Arabidopsis thaliana
MAETMKDITMKNDESQEEEIPDQFLCCVCLELLYKPIVLSCGHLSCFWCVHKSMNGFRESHCPICRDPYVHFPSVCQKLYFLLKKMYPLAHKKREEQVLKEEQERECFSPQIDLVLDLSVCSGDSLNVSDKQKVEECSNAANLLSSSSSRGDIPCIPKNQEPTDAKALNVHENELLKDNKVSKQISKDDLLCSACKELLVRPVVLNCGHVYCEGCVVDMAEESEKIKCQECNVCDPRGFPKVCLILEQLLEENFPEEYNSRSSKVQKTLAHNSKGNIQSYLKEGPSLSNDNNNDDPWLANPGSNVHFGAGCDSCGVYPIIGDRYRCKDCKEEIGYDLCKDCYETPSKVPGRFNQQHTPDHRLELARSPQVLINFNSIGILLGPVISNEGMDTDEGEEGPPGSSNESSSTE

SEQ ID NO: 2647 - DNA, 891 bp, Arabidopsis thaliana
atgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaa

SEQ ID NO: 2648 - protein, 296 aa, Arabidopsis thaliana
MPPLPSSTAPSSSRHLRSPESIAKFAGRAIFPALQGKSCPICLENLTERRSAAVITVCKHGYCLACIRKWSSFKRNCPLCNTRFDSWFIVSDFASRKYHKEQLPILRDRETLTYHRNNPSDRRRIIQRSRDVLENSSSRSRPLPWRRSFGRPGSVPDSVIFQRKLQWRASIYTKQLRAVRLHSRRLELSLAVNDYTKAKITERIEPWIRRELQAVLGDPDPSVIVHFASALFIKRLERENNRQTGQTGMLVEDEVSSLRKFLSDKVDIFWHELRCFAESILTMETYDAVVEYNEVE

SEQ ID NO: 2649 - DNA, 825 bp, Arabidopsis thaliana
atggggagaactaaggagcaggcaacattaactcggtatccaccctgtcctaggaatcctgctaaattcaatgatataaacaaagcactccaggaaaaaggatatggtaaggctctgaaaagaaaaccttggacgggtgtgacatgccctgtctgtcttgaggttcctcacaactcggtcgtcctcctttgttcatcttaccacaaaggatgccgtccgtacatgtgtgccacgggaaaccgtttctcaaattgtctagagcagtacaaaaaggcatatgccaaggatgagaaaagtgacaaaccgccagagctattgtgcccgctttgtaggggtcaggtgaaaggctggaccgttgtggaaaaggaacgtaagtatctgaattctaagaaaaggtcatgcatgaacgacgagtgtttgttttatggaagctatagacagctcaagaagcatgttaaggagaaccatccgagagccaagccaagagccatagaccctgtgctggaggcgaaatggaagaagcttgaggttgagagggagaggagtgatgtaatcagcacagtcatgtcgtcaacacctggggctatggtatttggagactatgtgattgagccatacaatggttatgatcatcaagatgacagtgacgattacagtgattcgtcggatgacgaaatggaaggtggggtattcgagcttggagcattcgacctgggccgtcttcaaccgcgttcggctgccatctcaagccggggaattcgcggtatgatcataaggaaccggtgggctcgaagcagaggtgcgagcagaaggcgacaaacataa

SEQ ID NO: 2650 - protein, 274 aa, Arabidopsis thaliana
MGRTKEQATLTRYPPCPRNPAKFNDINKALQEKGYGKALKRKPWTGVTCPVCLEVPHNSVVLLCSSYHKGCRPYMCATGNRFSNCLEQYKKAYAKDEKSDKPPELLCPLCRGQVKGWTVVEKERKYLNSKKRSCMNDECLFYGSYRQLKKHVKENHPRAKPRAIDPVLEAKWKKLEVERERSDVISTVMSSTPGAMVFGDYVIEPYNGYDHQDDSDDYSDSSDDEMEGGVFELGAFDLGRLQPRSAAISSRGIRGMIIRNRWARSRGASRRRQT

SEQ ID NO: 2651 - DNA, 666 bp, Arabidopsis thaliana
atgtgtgagtcaagcaacaaagtcagagtatcgccatacccgcttcggtcttcgaggaccgacaaacacaaggcgtcagagtcgcctattgagacaggttgggaggatgtgcgtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtga

SEQ ID NO: 2652 - protein, 221 aa, Arabidopsis thaliana
MCESSNKVRVSPYPLRSSRTDKHKASESPIETGWEDVRGCHPYMCDTSVRHSNCFKQFRRKTIKKRLYPKTLHCPLCRGEVSETTKVTSTARRFMNAKPRSCSVEDCKFSGTFSQLTKHLKTEHRGIVPPKVDPLRQQRWEMMERHSEYVELMTAAGISRMAEVMQQQLPQDQNHPHVFQVTVNGTIWNLIDPSQGRNGLGITNYSAMQFVPLSINHSRTL

SEQ ID NO: 2653 - DNA, 783 bp, Arabidopsis thaliana
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 2654 - protein, 260 aa, Arabidopsis thaliana
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 2655 - DNA, 2178 bp, Arabidopsis thaliana
atgtctcagtcaaacatggtaccagtggctaacaacggagacaacaacaacgacaacgaaaacaacaacaacaacaacaacaatggtggaactgacaacactaatgctggaaatgattctggagatcaagatttcgacagtgggaatacctcaagtggcaatcatggagaagggttgggaaacaatcaagctcctcgtcataagaagaaaaaatacaatcgtcacacccaacttcagatttcggagatggaagctttcttcagagagtgtcctcacccagatgacaaacaaaggtacgaccttagcgctcaattgggattggaccctgttcagatcaaattctggttccagaacaaacgcactcaaaacaagaatcaacaagaacgctttgagaactcagaacttcggaatctgaacaaccaccttaggtctgaaaatcagcggttacgagaagctattcatcaagccttatgccctaagtgtggaggccaaactgcaattggcgaaatgaccttcgaagagcaccatcttcgcatcctcaacgctcgtttgactgaagagatcaagcaactttccgtgacagcggaaaagatatcaaggcttacggggataccagtaaggagccatccccgtgtgtctcctcctaatcctcctccaaatttcgagttcgggatgggatctaagggaaatgtcggaaaccactcgagggaaaccactggacctgcagatgctaataccaagccgatcatcatggagttggcatttggagccatggaggagctcttggtgatggctcaagtggctgaaccactgtggatgggaggatttaatggcactagcttagctttgaacttggatgaatacgaaaagacgtttcgcacgggtctcggtcctagacttggcgggtttcgaaccgaggcatccagggaaactgcactcgtggcaatgtgtcctactggcattgttgaaatgctcatgcaagagaatctgtggtcaacaatgtttgccggaattgttggtagagccaggactcatgaacagataatggctgatgctgctggaaacttcaatggaaatctccaaataatgagtgctgagtaccaagtgctttccccgctagtcacaacccgcgaaagctacttcgtccgctactgtaagcaacaaggagagggtttgtgggcggtggtcgatatttccatcgaccatctcctcccaaacatcaacctaaaatgtcgccgccgaccctctggatgtctgattcaagaaatgcatagtggttactccaaggttacatgggtggaacatgtggaagtagatgatgcaggaagttacagcatctttgagaaattaatctgtactggtcaagcttttgctgctaaccgctgggttggtacattggtacgccagtgtgagcggatatctagcatcttgtcgacagattttcaatctgtcgattccggtgatcacataacgctaactaaccatggaaagatgagcatgctgaagatagctgagcggattgcgagaaccttctttgctggaatgaccaatgcgacggggtctacaatattttctggtgttgaaggagaagatatcagagtgatgacaatgaagagcgtgaatgatccaggaaagcctcccggtgtcattatttgtgcagccacttccttttggcttcctgctcctcctaacactgtctttgacttcctcagagaggctactcaccgacacaattgggatgttctctgcaacggagagatgatgcacaagatagcagagattacgaatgggatagacaaaaggaactgtgcaagtttactccggcatggacacactagcaagagcaagatgatgatagttcaagagacttctactgacccaacagcttcatttgtgctttatgcgcctgttgatatgacatcaatggatattactctccatggaggtggtgatcctgactttgtggtgatcctgccttctggttttgctatttttccagatggtacgggtaagcctggaggaaaagaaggaggatcacttttgaccatttccttccaaatgctggttgagtcaggtcctgaggctaggctgagtgttagctctgttgcaactactgagaatctgattcgtacaaccgtgcggaggatcaaagatttgtttccttgtcagactgcttga

SEQ ID NO: 2656 - protein, 725 aa, Arabidopsis thaliana
MSQSNMVPVANNGDNNNDNENNNNNNNNGGTDNTNAGNDSGDQDFDSGNTSSGNHGEGLGNNQAPRHKKKKYNRHTQLQISEMEAFFRECPHPDDKQRYDLSAQLGLDPVQIKFWFQNKRTQNKNQQERFENSELRNLNNHLRSENQRLREAIHQALCPKCGGQTAIGEMTFEEHHLRILNARLTEEIKQLSVTAEKISRLTGIPVRSHPRVSPPNPPPNFEFGMGSKGNVGNHSRETTGPADANTKPIIMELAFGAMEELLVMAQVAEPLWMGGFNGTSLALNLDEYEKTFRTGLGPRLGGFRTEASRETALVAMCPTGIVEMLMQENLWSTMFAGIVGRARTHEQIMADAAGNFNGNLQIMSAEYQVLSPLVTTRESYFVRYCKQQGEGLWAVVDISIDHLLPNINLKCRRRPSGCLIQEMHSGYSKVTWVEHVEVDDAGSYSIFEKLICTGQAFAANRWVGTLVRQCERISSILSTDFQSVDSGDHITLTNHGKMSMLKIAERIARTFFAGMTNATGSTIFSGVEGEDIRVMTMKSVNDPGKPPGVIICAATSFWLPAPPNTVFDFLREATHRHNWDVLCNGEMMHKIAEITNGIDKRNCASLLRHGHTSKSKMMIVQETSTDPTASFVLYAPVDMTSMDITLHGGGDPDFVVILPSGFAIFPDGTGKPGGKEGGSLLTISFQMLVESGPEARLSVSSVATTENLIRTTVRRIKDLFPCQTA

SEQ ID NO: 2657 - DNA, 766 bp, Arabidopsis thaliana
catcaccaatcttttgaatctaagagagagaagaagaagaaggtctagagaacgaaaagaagaaacatgaataaccagaatgtagatgatcataatcttctactcatttctcaattgtaccctaatgtctatactccattagtaccacaacaaggaggagaagcaaaaccaacacggcggaggaaaaggaagagcaagagtgttgtggtggcagaggagggtgaaaacgaaggcaatgggtggtttagaaagagaaaattgagtgatgagcaagtaagaatgttggagattagctttgaagacgatcataagcttgaatccgagaggaaagatcggcttgcttctgagttagggcttgatcctcgtcaagtcgccgtctggttccaaaaccgccgtgcacggtggaagaacaaacgagtcgaggatgaatacactaaactcaagaatgcatacgaaaccaccgtcgttgagaaatgtcgtcttgattctgaggttattcacctaaaggaacaactttacgaggctgaaagagagatccaacggcttgcaaaaagagttgaaggaactttaagtaacagtcctatctcatcctctgtgaccattgaagccaatcatacgacaccgttttttggagattacgacatcggatttgacggtgaggctgacgagaacttgctctactcgccagattacattgatggattagactggatgagccaatttatgtaaaaaactataagctaatctattttcagtcgtagtatag

SEQ ID NO: 2658 - protein, 220 aa, Arabidopsis thaliana
MNNQNVDDHNLLLISQLYPNVYTPLVPQQGGEAKPTRRRKRKSKSVVVAEEGENEGNGWFRKRKLSDEQVRMLEISFEDDHKLESERKDRLASELGLDPRQVAVWFQNRRARWKNKRVEDEYTKLKNAYETTVVEKCRLDSEVIHLKEQLYEAEREIQRLAKRVEGTLSNSPISSSVTIEANHTTPFFGDYDIGFDGEADENLLYSPDYIDGLDWMSQFM

SEQ ID NO: 2659 - DNA, 1440 bp, Arabidopsis thaliana
atcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttgc

SEQ ID NO: 2660 - protein, 406 aa, Arabidopsis thaliana
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 2661 - DNA, 1962 bp, Arabidopsis thaliana
atggatgatacaatggacatgagttcaggtagtgatgaagaagtacaagaagagaagaccactgttaacgagagggtcatctatcaggctgcattacaagatctgaagcaacccaagaccgaaaaggatctacctcctggtgttcttacagttcctcttatgaggcatcagaaaattgcattgaactggatgcgtaagaaagaaaaaagaagcaggcactgtttgggagggatattagcagatgatcagggacttggtaaaacgatctcgacgatctctcttatcctgttacaaaagttgaagtcacaatcaaagcagagaaagcgaaaaggtcaaaactctggtggtacattgattgtttgtccagcaagtgttgtaaaacaatgggcaagagaagttaaagagaaggtttctgatgaacacaaactctctgttttagtccaccatggatctcacagaaccaaagatccaacagaaatagcaatatatgatgtggtcatgacaacttacgccattgttacaaatgaagttccacaaaaccctatgctgaatcgttatgatagtatgagaggcagagaaagccttgacggatcgagtttgattcagcctcacgttggtgcactaggaagagttaggtggttgagagtagtattagatgaagctcatacaattaaaaaccatagaaccctaattgcaaaagcttgttttagccttagagccaaaaggagatggtgtttgactggaacgccgataaagaacaaagtagacgatctttatagctatttcagatttcttagatatcatccatatgccatgtgcaattcatttcaccaaagaatcaaagctccaattgataaaaagcctcttcatggttacaagaagcttcaagctattctaaggggtataatgttgcgccgcaccaaagaatggtctttctacaggaagcttgaattgaattcacgttggaagtttgaggaatatgctgctgatgggactttgcatgaacacatggcttatcttttggtgatgcttttgcgactacgccaagcttgtaaccatccacaacttgttaacggatatagtcactcagatactacaagaaaaatgtcagatggagttcgagtagcccctagagagaatctaatcatgttcctcgatctcttgaaattatcctcaaccacctgctctgtttgtagtgatccaccaaaagaccctgttgttactttgtgtggccatgtgttttgttatgagtgtgtgtctgtaaacattaacggggataacaatacgtgccctgcacttaattgccacagccagcttaaacatgatgttgttttcactgaatctgcagttagaagttgcatcaacgattatgatgatcctgaagataaaaatgctttagttgcatcaaggcgagtttatttcatcgaaaatccgagctgtgatagagattcttcagtcgcttgcagagcaaggcagtccagacactccaccaataaagacaatagtatcagtggactgaatctcatttttacgtttctcaaagacaaatgtaatgattatgaaacaggtgcgatgttgatgtctcttaaagctggaaaccttggattgaatatggtagctgcaagtcatgtcattctactggacctatggtggaatccaacaacagaggatcaagctattgatcgagctcatcgtatcggacaaactcgagctgttacggtcactcgtattgccatcaaaaataccgttgaggaacgaattttgactcttcatgaacgtaaaaggaacattgttgcatctgcattgggtgaaaaaaactggcaaaagttctgcgattcaactaacactagaagatctcgaatatctgttttttggtgtgtagaatatcccagagtttttattgataagaggaataaaacctttagctatttaataagtcacaagtgtgaatgtaatgaataa

SEQ ID NO: 2662 - protein, 653 aa, Arabidopsis thaliana
MDDTMDMSSGSDEEVQEEKTTVNERVIYQAALQDLKQPKTEKDLPPGVLTVPLMRHQKIALNWMRKKEKRSRHCLGGILADDQGLGKTISTISLILLQKLKSQSKQRKRKGQNSGGTLIVCPASVVKQWAREVKEKVSDEHKLSVLVHHGSHRTKDPTEIAIYDVVMTTYAIVTNEVPQNPMLNRYDSMRGRESLDGSSLIQPHVGALGRVRWLRVVLDEAHTIKNHRTLIAKACFSLRAKRRWCLTGTPIKNKVDDLYSYFRFLRYHPYAMCNSFHQRIKAPIDKKPLHGYKKLQAILRGIMLRRTKEWSFYRKLELNSRWKFEEYAADGTLHEHMAYLLVMLLRLRQACNHPQLVNGYSHSDTTRKMSDGVRVAPRENLIMFLDLLKLSSTTCSVCSDPPKDPVVTLCGHVFCYECVSVNINGDNNTCPALNCHSQLKHDVVFTESAVRSCINDYDDPEDKNALVASRRVYFIENPSCDRDSSVACRARQSRHSTNKDNSISGLNLIFTFLKDKCNDYETGAMLMSLKAGNLGLNMVAASHVILLDLWWNPTTEDQAIDRAHRIGQTRAVTVTRIAIKNTVEERILTLHERKRNIVASALGEKNWQKFCDSTNTRRSRISVFWCVEYPRVFIDKRNKTFSYLISHKCECNE

SEQ ID NO: 2663 - DNA, 1502 bp, Arabidopsis thaliana
attcacatttttatttatctttccatttagccattctgttccctgtctcttcctcctctctttttgacacatcacatcatcatcacatcatcattcaacatcaatcatcatcatatgcatacacatacatctgtgttctgcggatcgagttaattagttatggcttcttcgaatagacactggccaagcatgttcaagtccaaacctcatccccatcaatggcaacatgacatcaactctcctctcttgccttctgcttctcaccgatcttctcctttctcttcaggatgtgaagtggagaggagtccagagccaaaaccaagatggaatccaaagccagagcagattcggatacttgaagcaatctttaactccgggatggtgaatcctccaagagaggagatcaggcttcaagaatacggccaagtcggtgatgctaacgtcttctactggttccaaaaccgtaagtcccgtagtaaacacaaactccgcctcctccacaaccactccaaacactctctccctcaaacgcaaccgcagccgcagccgcaaccttcggcttcctcttcctcttcctcctcctcttcctcctccaaatccaccaaaccccgaaaaagcaagaacaagaacaacactaatctctctttgggtggtagtcaaatgatggggatgtttccaccggaaccggcgtttctcttcccggtctccactgtcggagggtttgaaggtatcaccgtctcatcccaattagggtttctctccggtgatatgattgagcaacaaaaaccggctccaacgtgtaccggactcctgctgagtgagatcatgaacggtagtgtgagttatggaactcatcatcaacaacacttgagtgagaaagaagttgaagaaatgaggatgaagatgttgcaacagccacagactcagatttgttacgctaccactaatcatcaaatagcttcttacaacaacaacaacaacaacaataacatcatgcttcatattcctcccactacttctactgccaccactattactacttcgcattctctcgctactgtcccatcaacttcggaccagcttcaagttcaagcggacgcacgaataagagttttcatcaatgaaatggagcttgaagtgagctcaggaccgttcaatgtgagggatgcatttggggaagaggttgttctgattaattccgcgggtcagcccattgtcaccgatgaatatggcgtcgctcttcaccctcttcaacacggagcctcgtactatctgatctagtcgtgtgggagatttgagtttgaagaagaaattaagacctgtctctttctttcaccatctctcgtacgtaggcttaaatgttaagattttataaagtattggtttcagttacctgttgtgacggtgtttatgtatgagtttcggacaacattcacaaaactctctcgttaaattgttgaccaataatatatgatgtgtgtttcattattatctaaaaaaaa

SEQ ID NO: 2664 - protein, 373 aa, Arabidopsis thaliana
MASSNRHWPSMFKSKPHPHQWQHDINSPLLPSASHRSSPFSSGCEVERSPEPKPRWNPKPEQIRILEAIFNSGMVNPPREEIRLQEYGQVGDANVFYWFQNRKSRSKHKLRLLHNHSKHSLPQTQPQPQPQPSASSSSSSSSSSSKSTKPRKSKNKNNTNLSLGGSQMMGMFPPEPAFLFPVSTVGGFEGITVSSQLGFLSGDMIEQQKPAPTCTGLLLSEIMNGSVSYGTHHQQHLSEKEVEEMRMKMLQQPQTQICYATTNHQIASYNNNNNNNNIMLHIPPTTSTATTITTSHSLATVPSTSDQLQVQADARIRVFINEMELEVSSGPFNVRDAFGEEVVLINSAGQPIVTDEYGVALHPLQHGASYYLI

SEQ ID NO: 2665 - DNA, 807 bp, Arabidopsis thaliana
atgaatcaagaaggtgcttcacatagcccatcctccacttccaccgaaccagtccgggcacgttggtcacctaaaccggagcaaatcttgatactcgaatccatcttcaacagtggtactgttaacccaccaaaagatgaaacggtgaggataagaaagatgcttgagaaattcggtgctgtgggagacgcaaacgtcttctactggtttcaaaaccgacggtcaagatctcgccggagacaccggcagcttttagcagccaccaccgcagccgccacctccataggagctgaagaccaccagcacatgacggccatgagcatgcatcaatatccttgcagcaacaacgagattgatttggggtttggaagttgtagcaacttatcagctaattacttccttaatggatcgtcgtcatctcaaatcccttcctttttcctcggcctctcttcttcaagtggtgggtgtgagaacaacaatggtatggagaatctcttcaaaatgtatggccatgaatctgatcataatcatcagcagcagcatcatagctcaaatgctgcatcagttttaaacccatctgatcaaaactccaactcccaatacgaacaagaagggtttatgacggtgtttataaacggagttcctatggaagtaacaaaaggagcaatagacatgaaaacaatgttcggtgatgattcggtgttacttcattcctctggtcttcctcttcccactgatgagtttggtttcttgatgcattctttacaacatggacaaacttatttcctggtaccgagacagacatga

SEQ ID NO: 2666 - protein, 268 aa, Arabidopsis thaliana
MNQEGASHSPSSTSTEPVRARWSPKPEQILILESIFNSGTVNPPKDETVRIRKMLEKFGAVGDANVFYWFQNRRSRSRRRHRQLLAATTAAATSIGAEDHQHMTAMSMHQYPCSNNEIDLGFGSCSNLSANYFLNGSSSSQIPSFFLGLSSSSGGCENNNGMENLFKMYGHESDHNHQQQHHSSNAASVLNPSDQNSNSQYEQEGFMTVFINGVPMEVTKGAIDMKTMFGDDSVLLHSSGLPLPTDEFGFLMHSLQHGQTYFLVPRQT

SEQ ID NO: 2667 - DNA, 816 bp, Arabidopsis thaliana
atgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactga

SEQ ID NO: 2668 - protein, 271 aa, Arabidopsis thaliana
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 2669 - DNA, 2232 bp, Arabidopsis thaliana
atgtaccatccaaacatgtttgagagccatcatatgttcgatatgaccccaaagagtacctctgataacgacttgggaatcaccggtagccgagaagatgactttgagaccaagtcaggtaccgaagtcactactgagaatccttctggtgaagagcttcaagatcctagccaacgtcccaacaaaaagaagcgttaccatcgccacacgcaacgccaaattcaagagctcgaatcattctttaaggaatgtcctcatccagatgataagcaacgaaaagagttgagccgtgatctcaatttagagcctcttcaagttaagttttggttccaaaacaaacgcacacagatgaaggcacaaagtgagaggcatgagaaccagattctaaagtcagacaatgacaagctcagagcagagaacaatagatacaaagaagctctaagcaatgctacatgccctaactgtggcggtccagctgctattggagaaatgtcttttgacgaacaacatctcaggatcgaaaatgctcggctccgcgaagagattgataggatctctgctattgctgcgaaatacgttgggaagccgttaggatcgtctttcgctccactagcgatccacgcgccttctcgttcgcttgatcttgaagttggaaactttgggaaccagacaggctttgtaggagaaatgtatggaacaggggacattttgaggtcagtttcgattccttctgagactgataagcctataatcgtggagctagcggttgcagctatggaggaactcgtgagaatggctcaaactggagatcctttatggctttcaaccgataattcagtcgagattctcaacgaagaagagtatttcagaacgtttccgagaggaattggaccaaagccattaggattaagatcagaggcgtcaagacaatctgcagttgttataatgaatcacatcaatctcgttgagattctcatggatgtgaatcaatggtcttgtgttttctctgggattgtgtcaagagccttgacacttgaagttctttcaactggagttgctgggaactacaacggtgctttacaagtgatgacagctgagtttcaagttccatcacccctagtcccaacgcgtgagaactactttgtgagatactgcaaacaacacagtgacggctcttgggctgtggttgatgtctctttggacagccttagaccaagtactccaatcttaagaactagaagaaggccttcaggttgtctgattcaagaattgcctaatggttattctaaggttacatggatagagcatatggaggtagatgatagatcagttcacaacatgtataaaccgttggttcagtccggtttagctttcggtgcgaaacgttgggtggctacactcgaacgacaatgcgagcggcttgctagctccatggccagcaacattcctggtgatctttccgtgataacgagtcctgaaggaaggaagagtatgttgaagctagctgagagaatggttatgagtttctgcagtggtgttggcgcgtcgactgcacacgcttggacaacaatgtcgacaacaggatccgatgatgttcgggtcatgacccgcaagagtatggatgatccaggaagacctccgggtattgttcttagtgcagctacttcattctggatcccagttgctcccaaacgtgtttttgatttcctccgtgacgaaaattcaagaaaagagtgggatattctgtcaaatggaggtatggttcaggaaatggctcatatagccaatggtcatgaacctggaaactgtgtctccttgctccgagtcaatagtggaaactcgagccagagcaacatgttgattctacaagagagctgtacagatgcatcaggatcgtatgtgatttacgcgccagtggatatagtggcgatgaatgtggttctaagcggtggagatcctgattacgtggcgttgttgccgtctggttttgctattttaccggatggttcggttggaggaggagatgggaatcagcatcaggaaatggtttctactacttcttctgggagttgtggtggttcgcttttaaccgttgcgtttcagattcttgttgactctgttcctacagctaaactctcacttggctcggtggctacggttaatagtctgatcaaatgtacggtggagaggattaaagctgctgtttcttgtgatgttggaggaggagcgtag

SEQ ID NO: 2670 - protein, 743 aa, Arabidopsis thaliana
MYHPNMFESHHMFDMTPKSTSDNDLGITGSREDDFETKSGTEVTTENPSGEELQDPSQRPNKKKRYHRHTQRQIQELESFFKECPHPDDKQRKELSRDLNLEPLQVKFWFQNKRTQMKAQSERHENQILKSDNDKLRAENNRYKEALSNATCPNCGGPAAIGEMSFDEQHLRIENARLREEIDRISAIAAKYVGKPLGSSFAPLAIHAPSRSLDLEVGNFGNQTGFVGEMYGTGDILRSVSIPSETDKPIIVELAVAAMEELVRMAQTGDPLWLSTDNSVEILNEEEYFRTFPRGIGPKPLGLRSEASRQSAVVIMNHINLVEILMDVNQWSCVFSGIVSRALTLEVLSTGVAGNYNGALQVMTAEFQVPSPLVPTRENYFVRYCKQHSDGSWAVVDVSLDSLRPSTPILRTRRRPSGCLIQELPNGYSKVTWIEHMEVDDRSVHNMYKPLVQSGLAFGAKRWVATLERQCERLASSMASNIPGDLSVITSPEGRKSMLKLAERMVMSFCSGVGASTAHAWTTMSTTGSDDVRVMTRKSMDDPGRPPGIVLSAATSFWIPVAPKRVFDFLRDENSRKEWDILSNGGMVQEMAHIANGHEPGNCVSLLRVNSGNSSQSNMLILQESCTDASGSYVIYAPVDIVAMNVVLSGGDPDYVALLPSGFAILPDGSVGGGDGNQHQEMVSTTSSGSCGGSLLTVAFQILVDSVPTAKLSLGSVATVNSLIKCTVERIKAAVSCDVGGGA

SEQ ID NO: 2671 - DNA, 2385 bp, Arabidopsis thaliana
accaaactcacatagcaatcacacacatctccacaaacacagcttgagatgatcatgaaacacgtgcatcctcagatctctatcaatccagcttggtgaaagaaggtcaagaattgaaagagaatcaaagaaaacgacgtcgtttcattcgtgtgtaacaactactaattatacatagatggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccataccctaaggattcggacaagcacatgctagctaagcaaacaggactcactcgtagccaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggatgccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacggaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataaacccatctctctagaaggagaaaccgaaacaggttattatatacgtttctagtttttaattagtatatagtttctcataccattgaaccaaaacaaagaacaaaatttaattttagtctttggttatatatggccgacgggctacgtcagggccctgacgtagc

SEQ ID NO: 2672 - protein, 680 aa, Arabidopsis thaliana
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGCPKRLRTSDETMMQPINADFSSNEKLTMKILEERQGIRSDGGYPFMGNFGQYQMDEMSRFDVVSDQELMAQRYSGNNNGVSLTLGLPHCDSLSSTDHQGFMQTHHGIPIGRRVKIGETEEYGPATINGGSSTTTAHSSAAAAAAYNGMNIQNQKRYVAQLLPDFVA

SEQ ID NO: 2673 - DNA, 984 bp, Arabidopsis thaliana
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 2674 - protein, 327 aa, Arabidopsis thaliana
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 2675 - DNA, 1164 bp, Arabidopsis thaliana
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 2676 - protein, 387 aa, Arabidopsis thaliana
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 2677 - DNA, 668 bp, Arabidopsis thaliana
gagtaatcatcaacgattatggcgtcaagtcagtggacgaggtcggaggataagatgtttgagcaagctttggttctttttcctgaaggatctcctaatcggtgggagagaatcgctgatcagcttcataaatctgctggtgaagttagggagcattacgaggtcttggttcatgatgttttcgagattgattctggtcgagttgatgtccctgattacatggatgactcggcggctgcggcggcgggttgggattccgctggtcagatctcttttgggtctaaacatggcgagagtgaacgcaaaagaggaactccttggacagagaacgaacacaaattgtttctgatcggattaaagagatatggtaagggagattggaggagtatctcgagaaacgttgtggtgacgaggacaccgacgcaagtcgcgagtcacgctcagaagtattttctgagacagaactcggtgaagaaggagaggaaaaggtcgagcatccatgatataactacggttgatgctactttggctatgcctgggtctaacatggactggactggccaacacgggagtcctgttcaggcgccgcagcagcaacagattatgtctgagttcggtcagcaattgaatcctggtcatttcgaggattttgggtttcggatgtgatg

SEQ ID NO: 2678 - protein, 215 aa, Arabidopsis thaliana
MASSQWTRSEDKMFEQALVLFPEGSPNRWERIADQLHKSAGEVREHYEVLVHDVFEIDSGRVDVPDYMDDSAAAAAGWDSAGQISFGSKHGESERKRGTPWTENEHKLFLIGLKRYGKGDWRSISRNVVVTRTPTQVASHAQKYFLRQNSVKKERKRSSIHDITTVDATLAMPGSNMDWTGQHGSPVQAPQQQQIMSEFGQQLNPGHFEDFGFRM

SEQ ID NO: 2679 - DNA, 867 bp, Arabidopsis thaliana
atggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatag

SEQ ID NO: 2680 - protein, 288 aa, Arabidopsis thaliana
MEVMRPSTSHVSGGNWLMEETKSGVAASGEGATWTAAENKAFENALAVYDDNTPDRWQKVAAVIPGKTVSDVIRQYNDLEADVSSIEAGLIPVPGYITSPPFTLDWAGGGGGCNGFKPGHQVCNKRSQAGRSPELERKKGVPWTEEEHKLFLMGLKKYGKGDWRNISRNFVITRTPTQVASHAQKYFIRQLSGGKDKRRASIHDITTVNLEEEASLETNKSSIVVGDQRSRLTAFPWNQTDNNGTQADAFNITIGNAISGVHSYGQVMIGGYNNADSCYDAQNTMFQL

SEQ ID NO: 2681 - DNA, 1077 bp, Arabidopsis thaliana
atgggtcatcactcatgctgcaacaagcaaaaggtgaagagagggctttggtcacctgaagaagacgaaaagctcatcaactacatcaattcatatggccatggatgttggagctctgttcctaaacatgcaggtttgcagagatgtggaaagagttgtagattaagatggataaattatctaagacctgatcttaaacgtggaagcttctctcctcaagaagctgctcttatcattgagcttcacagcattcttggtaacagatgggctcaaattgctaaacatctacctggaagaacagataacgaggtcaagaatttctggaactcgagcattaaaaagaagctcatgtctcaccatcatcacggtcatcatcatcatcatctctcttccatggcgagtttgctcacaaaccttccttatcacaatggattcaaccctactacagtcgacgatgaaagttcaagattcatgtccaatatcatcacaaacactaaccctaatttcatcactccaagccatctctctcttccttctcctcatgttatgaccccattgatgttcccaacctctagagaaggagatttcaagtttctaaccacaaacaacccaaaccaatctcatcaccatgataataaccattacaacaacctcgacattttgtcacccacaccaactataaacaatcatcatcaaccttcactttcttcttgtcctcatgataataatctccaatggccagcgttaccagatttcccagcgagtaccatttctggtttccaagaaacccttcaagattatgatgatgctaataaactcaacgtgtttgtgacaccattcaacgataatgccaaaaagttattatgtggagaagttctcgaaggcaaagtactatcttcctcctcaccaatttcacaagatcacggcctttttcttcccaccacgtacaactttcaaatgacttctacgagtgatcatcaacatcatcatcgagtggactcatacatcaatcacatgatcataccatcatcatcctcatcgtcgccaatctcttgtggacagtacgtcataacttaa

SEQ ID NO: 2682 - protein, 358 aa, Arabidopsis thaliana
MGHHSCCNKQKVKRGLWSPEEDEKLINYINSYGHGCWSSVPKHAGLQRCGKSCRLRWINYLRPDLKRGSFSPQEAALIIELHSILGNRWAQIAKHLPGRTDNEVKNFWNSSIKKKLMSHHHHGHHHHHLSSMASLLTNLPYHNGFNPTTVDDESSRFMSNIITNTNPNFITPSHLSLPSPHVMTPLMFPTSREGDFKFLTTNNPNQSHHHDNNHYNNLDILSPTPTINNHHQPSLSSCPHDNNLQWPALPDFPASTISGFQETLQDYDDANKLNVFVTPFNDNAKKLLCGEVLEGKVLSSSSPISQDHGLFLPTTYNFQMTSTSDHQHHHRVDSYINHMIIPSSSSSSPISCGQYVIT

SEQ ID NO: 2683 - DNA, 348 bp, Arabidopsis thaliana
atgaaattgattgattggaaagactgtgctttgatgacttacaccgaactcattttgggtttctgcaatgttttaatgttgatctgcaggaggactagtggacctatgagacgagcaaaaggtggttggactccagaggaggatgagacacttagacgagcagttgaaaagtataaggggaagaggtggaagaaaatagcggaatttttcccagagagaacacaagtccaatgcttgcacaggtggcagaaagttcttaatccagagcttgttaaaggaccttggactcaagaggttctcttatcattttcatgttctgaaactttttttggttttcattttacgtaa

SEQ ID NO: 2684 - protein, 115 aa, Arabidopsis thaliana
MKLIDWKDCALMTYTELILGFCNVLMLICRRTSGPMRRAKGGWTPEEDETLRRAVEKYKGKRWKKIAEFFPERTQVQCLHRWQKVLNPELVKGPWTQEVLLSFSCSETFFGFHFT

SEQ ID NO: 2685 - DNA, 1471 bp, Arabidopsis thaliana
attcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaacttaattccaactattttcaaagtggatgtacaaagtaaaa

SEQ ID NO: 2686 - protein, 416 aa, Arabidopsis thaliana
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGFSYYRSPN

SEQ ID NO: 2687 - DNA, 871 bp, Arabidopsis thaliana
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 2688 - protein, 207 aa, Arabidopsis thaliana
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 2689 - DNA, 704 bp, Arabidopsis thaliana
ttctctctgtgaatccttgttcatcgtcactgaaattagtttacaaaatcgacgaattcggagatgatttttcagaatgtgtgcagaaatgagtccaacttcaacgctatagcttccgaatcgcgttcccaaacgcagttcggtgtttcgaaatcctcctcgagcggcggcggatgtatctccgccaggactaaagaccgtcacacgaaggttaacggacgaagccgtcgagttacgatgccggctctcgccgccgctaggattttccagttaacgcgtgagctcggtcacaaaactgaaggagaaaccatcgaatggcttcttagtcaagctgaaccgtcgattattgccgccactggctacgggactaagctcatttcgaattgggttgatgttgcggcggacgattcctcgtcgtcgtcgtcgatgacgtcgccgcaaacgcaaacgcaaacgccacaatcgccgagttgtaggttggatctttgtcagccaatcggaattcagtatccggtgaatggttacagtcatatgccgttcacagcgatgcttttagagccgatgaccacgacggcggaatctgaggttgagatcgcggaggaggaggaacgtagacgccgtcaccattagtaaaattaggcttttgatttagagtgttaaaattaggattttaaaagtttaggaggtaacagataaggataatt

SEQ ID NO: 2690 - protein, 188 aa, Arabidopsis thaliana
MIFQNVCRNESNFNAIASESRSQTQFGVSKSSSSGGGCISARTKDRHTKVNGRSRRVTMPALAAARIFQLTRELGHKTEGETIEWLLSQAEPSIIAATGYGTKLISNWVDVAADDSSSSSSMTSPQTQTQTPQSPSCRLDLCQPIGIQYPVNGYSHMPFTAMLLEPMTTTAESEVEIAEEEERRRRHH

SEQ ID NO: 2691 - DNA, 1891 bp, Arabidopsis thaliana
catcatgagcgtatgagagtaaattcttctcacatattaataacaacccttcaaagttataagatttttagagagagagctaccacgttttcgtatctccgggaacgatggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaattta

SEQ ID NO: 2692 - protein, 518 aa, Arabidopsis thaliana
MDESSIIPAEKVAGAEKKELQGLLKTAVQSVDWTYSVFWQFCPQQRVLVWGNGYYNGAIKTRKTTQPAEVTAEEAALERSQQLRELYETLLAGESTSEARACTALSPEDLTETEWFYLMCVSFSFPPPSGMPGKAYARRKHVWLSGANEVDSKTFSRAILAKSAKIQTVVCIPMLDGVVELGTTKKVREDVEFVELTKSFFYDHCKTNPKPALSEHSTYEVHEEAEDEEEVEEEMTMSEEMRLGSPDDEDVSNQNLHSDLHIESTHTLDTHMDMMNLMEEGGNYSQTVTTLLMSHPTSLLSDSVSTSSYIQSSFATWRVENGKEHQQVKTAPSSQWVLKQMIFRVPFLHDNTKDKRLPREDLSHVVAERRRREKLNEKFITLRSMVPFVTKMDKVSILGDTIAYVNHLRKRVHELENTHHEQQHKRTRTCKRKTSEEVEVSIIENDVLLEMRCEYRDGLLLDILQVLHELGIETTAVHTSVNDHDFEAEIRAKVRGKKASIAEVKRAIHQVIIHDTNL

SEQ ID NO: 2693 - DNA, 898 bp, Arabidopsis thaliana
tcccactatccttcgcaagacccttcctctatataaggaagttcatttcatttggagaggacacgctgacaagctgactctagcagatctggtaccgtcgaccctctctatataatcttcttctacacacacacacacacgcaaccatatacgtacatgtgaagtagtgagatcaatatcgttagcaatgaatctaccaccgggatttaggttttttccgaccgatgaagagctcgtcgttcacttcctccaccggaaagcttccctcttgccttgtcaccctgatgtcatccccgaccttgatctttaccattacgatccttgggaccttcccgggaaagctttgggagaagggaggcaatggtacttctatagtagaaagacacaagagagagtgacaagcaatgggtattggggatcaatgggaatggacgagccaatctacacaagctccacacacaagaaagtgggaatcaaaaagtatctaactttctatctcggagattctcagactaattggatcatgcaagaatattccctcccggattcctcttcttcatctagtcgatcttctaagagatcaagccgtgcttctagttctagtcacaaacccgattatagcaagtgggtgatatgcagagtgtatgagcaaaattgcagtgaggaggaagacgatgatgggacagaactctcatgtttggatgaagtgtttttgtctttagatgatcttgacgaagtaagcttaccgtaataaagacagaagcacccaagaagagaaaaaaaaaaaaagggtttagtgggcaattatttctaagcgaccgctctagacaggcctagtaccggatcctctagctagagctttcgttcgtatcatcggtttcgacaacgttcgtcaagt

SEQ ID NO: 2694 - protein, 187 aa, Arabidopsis thaliana
MNLPPGFRFFPTDEELVVHFLHRKASLLPCHPDVIPDLDLYHYDPWDLPGKALGEGRQWYFYSRKTQERVTSNGYWGSMGMDEPIYTSSTHKKVGIKKYLTFYLGDSQTNWIMQEYSLPDSSSSSSRSSKRSSRASSSSHKPDYSKWVICRVYEQNCSEEEDDDGTELSCLDEVFLSLDDLDEVSLP

SEQ ID NO: 2695 - DNA, 777 bp, Arabidopsis thaliana
atgaaaatgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaa

SEQ ID NO: 2696 - protein, 258 aa, Arabidopsis thaliana
MKMMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 2697 - DNA, 1123 bp, Arabidopsis thaliana
aaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaa

SEQ ID NO: 2698 - protein, 268 aa, Arabidopsis thaliana
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGAKASASASVSATDSVEAEQWNGGGGDCNMEEWMNMMMMMDFGNGDSSDSGNTIADMFQ

SEQ ID NO: 2699 - DNA, 933 bp, Arabidopsis thaliana
aaaaaaaaaaaaaaaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgataattaatcttgaaatttgttttgttcattctgcaatttctttggttctcttattttttgtttgttgtatccaaatgaaattattggaagagatggtgatgttaaagtgtatatatataaaaaaaaaa

SEQ ID NO: 2700 - protein, 243 aa, Arabidopsis thaliana
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 2701 - DNA, 1432 bp, Arabidopsis thaliana
  misc_feature (1419)..(1419): n is a, c, g, or t
atcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagtaagtaatgatcagcgagagttaaaacataaaagtacttagagtaatctaacgatgcataataaggaatgttcaacaggacttgaacatgatttcaatactaagagagatttatctagctactggtagtagccgcagacttcttgttgtagcttcacttnctttttgttgctt

SEQ ID NO: 2702 - protein, 324 aa, Arabidopsis thaliana
MEGRDMLSWEQKTLLSELINGFDAAKKLQARLREAPSPSSSFSSPATAVAETNEILVKQIVSSYERSLLLLNWSSSPSVQLIPTPVTVVPVANPGSVPESPASINGSPRSEEFADGGGSSESHHRQDYIFNSKKRKMLPKWSEKVRISPERGLEGPQDDVFSWRKYGQKDILGAKFPRSYYRCTHRSTQNCWATKQVQRSDGDATVFEVTYRGTHTCSQAITRTPPLASPEKRQDTRVKPAITQKPKDILESLKSNLTVRTDGLDDGKDVFSFPDTPPFYNYGTINGEFGHVESSPIFDVVDWFNPTVEIDTTFPAFLHESIYY

SEQ ID NO: 2703 - DNA, 896 bp, Arabidopsis thaliana
gtccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgtatatagatgtatatatatatatcaccaattcaccatcgtaatcacgtctcacatgtaactacgtacatatatcttgttcggggttcgttttgtaatgtattgaattggtggaggtagaatggaagtcatcttgtatagttgtacttgtatgtaaggtttgatagtcattttttataaagtaactaatttgtacaa

SEQ ID NO: 2704 - protein, 202 aa, Arabidopsis thaliana
MNYPSNPNPSSTDFTEFFKFDDFDDTFEKIMEEIGREDHSSSPTLSWSSSEKLVAAEITSPLQTSLATSPMSFEIGDKDEIKKRKRHKEDPIIHVFKTKSSIDEKVALDDGYKWRKYGKKPITGSPFPRHYHKCSSPDCNVKKKIERDTNNPDYILTTYEGRHNHPSPSVVYCDSDDFDLNSLNNWSFQTANTYSFSHSAPY

SEQ ID NO: 2705 - DNA, 1135 bp, Arabidopsis thaliana
gtacatttttttttgtatttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacccattttcttcttcttcttactataatcctcatgcatctttcttcccttcacattccacaaccacttacccggatatttattctggatccatgacctatccatcttcattcgggtcggatcttcaacaacccgaaaactaccaatctcagttccattaccaaaacactatcacttacactcaccaagacaacaacacttgcatgctcaacttcattgagccgagccaaccggattttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgacgttggcgaatacggacctattcaagctgccgttgacgccaagctagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaacttgtttgtattttcttttaaactttagggttattagctgtgcgtaaaatttgtaatttagcattttgtatgaatgtaatgcaagtgtgtaaattatggacagctcaagcttttttgttaaaa

SEQ ID NO: 2706 - protein, 314 aa, Arabidopsis thaliana
MADLFGGGHGGELMEALQPFYKSASTSASNPAFASSNDAFASAPNDPFSSSSYYNPHASFFPSHSTTTYPDIYSGSMTYPSSFGSDLQQPENYQSQFHYQNTITYTHQDNNTCMLNFIEPSQPDFMTQPGPSSGSVSKPAKLYRGVRQRHWGKWVAEIRLPRNRTRLWLGTFDTAEEAALAYDRAAFKLRGDSARLNFPALRYQTGSSPSDVGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 2707 - DNA, 1410 bp, Arabidopsis thaliana
aggctattctcggaaaaacaaagaataaagaatgaattcgttttcacaagtacctcctggcttcagatttcatcctactgatgaagaacttgtagactactacttgaggaaaaaagttgcatcaaagagaatagaaatcgatatcatcaaggatgttgatctttacaagattgagccatgtgatcttcaagagttatgcaagataggaaacgaagagcagagcgaatggtacttctttagtcataaagacaagaagtatcccacgggaactcgaaccaatagagccacgaaagcaggattttggaaagccactggaagagacaaggctatatatataagacatagtcttatcggtatgaggaaaacacttgtgttttacaaaggaagagccccaaatggtcagaaatccgattggatcatgcacgaatatcgcttagaaacaagtgaaaatggaacccctcaggaagaaggatgggtagtatgtagggtattcaagaagaaattggcagcgacagtgaggaaaatgggagattaccattcatcaccatcgcagcattggtacgatgatcagctctcttttatggcctccgagatcatttctagttctccacgacagtttcttcccaatcatcattataaccgccaccatcaccagcagacattgccttgtggcctcaatgcattcaacaacaacaatcctaacttgcaatgcaagcaagagctcgagttacattacaatcaaatggtacaacatcaacaacaaaaccatcatcttcgtgaatctatgtttctccagcttcctcagctcgaaagccctaccagtaattgcaattctgacaacaacaataacacaagaaatattagtaacttgcagaaatcatcaaatatatctcatgaggaacaattgcaacaagggaatcaaagtttcagctctctgtattacgatcaaggagtagagcaaatgactactgactggagagttctcgataaatttgttgcttcacagcttagcaatgatgaagaggctgcagccgtggtttcttcttcttctcatcaaaacaacgtcaagattgacacgagaaacacgggttatcatgtgatagatgagggaataaatttgccggagaatgattctgaaagggttgttgaaatgggagaagagtattcaaatgctcatgctgcttctacttcttcaagttgtcagattgatctctagaaatagtgatagagagatgaaaaagatgcaaggtgaatatatatgaaaatacatgcacactagtgttatttatacttaaagatggaaggggaaaaacaaggagttatttcctggatttatggaggttttgtacataataaaaacctacaaccatatggtattttcttttgaaaaaaaaaaaaaaaaaaaaaaaa

SEQ ID NO: 2708 - protein, 394 aa, Arabidopsis thaliana
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 2709 - DNA, 1596 bp, Arabidopsis thaliana
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaa

SEQ ID NO: 2710 - protein, 531 aa, Arabidopsis thaliana
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 2711 - DNA, 1634 bp, Arabidopsis thaliana
cttccttttgcttcagctgcgagctttggttggatctctcacttgcaaaaccaaatcccttatcgacttccaccgaaagatcacttcttaacctacacaaggtgtttgttatgaagatcagataaataaaaggtcatttgaggataatggttgatgttcaaagattcttacttgcttatttgtgatggacaatgtaagaggttcaataatgttgcagccactgccagagatagctgagagtatcgatgatgctatctgccatgaactctccatgtggcctgatgatgctaaagatttgttattgatagtggaggcaatatcaaggggagacttgaagttggtacttgttgcttgtgcaaaagctgtttctgagaataatcttctaatggcacgatggtgtatgggtgagttgcgcggtatggtttcgatttctggtgagccaatccagagattgggagcttatatgttagaagggcttgttgctaggcttgctgcttctggtagttcgatatataagtctctccagtccagagaaccagagagttatgaatttttatcttatgtgtatgttctgcatgaggtttgtccatatttcaagtttggatacatgtcagcgaatggtgcgattgcagaagcaatgaaggatgaagagaggattcacattattgacttccaaattggacaagggagccagtggatagcacttatccaggcttttgcagctaggcctggtggggctccaaatattcgaattaccggagttggtgatggatctgtcttggttacagtcaagaagagactagagaaacttgcaaagaagtttgatgttccattcaggttcaatgcggtttcaaggccaagttgtgaagttgaagtggaaaatcttgatgtccgagatggcgaagcccttggagtgaactttgcttacatgctgcatcatttgccagatgagagtgtaagcatggaaaaccacagggaccggttgctgaggatggtgaagagtctatcacctaaagtagtcactcttgtggaacaagaatgcaacacgaacacttcccctttccttcctaggttccttgagacattaagttattacacggcaatgttcgaatctatcgatgttatgcttccgagaaatcacaaggaaaggatcaatatcgagcagcactgcatggcaagggatgtcgtcaacatcatagcttgtgaaggagccgagaggatcgaaagacacgagcttctcgggaaatggaagtcaaggttttccatggcgggttttgagccataccccttgagctcaatcatttcagccaccattagagccctcttgagagattacagcaacgggtatgcgattgaagaaagagatggtgctctgtaccttggttggatggaccgaatcttggtctcatcttgtgcatggaagtgaaagaataaacgtctccaagaatgtaatgcaaaagacagaactggaagtaatagatagttttgtctcataaccattaataaggttgaatcaaatcatatacatccccatgctacaactattacacaggctccatcaacaaagaagggctcttgttgtgttaccttctcttcctgtaactcttatttgaaccaaatggaagtggttacat

SEQ ID NO: 2712 - protein, 413 aa, Arabidopsis thaliana
MDNVRGSIMLQPLPEIAESIDDAICHELSMWPDDAKDLLLIVEAISRGDLKLVLVACAKAVSENNLLMARWCMGELRGMVSISGEPIQRLGAYMLEGLVARLAASGSSIYKSLQSREPESYEFLSYVYVLHEVCPYFKFGYMSANGAIAEAMKDEERIHIIDFQIGQGSQWIALIQAFAARPGGAPNIRITGVGDGSVLVTVKKRLEKLAKKFDVPFRFNAVSRPSCEVEVENLDVRDGEALGVNFAYMLHHLPDESVSMENHRDRLLRMVKSLSPKVVTLVEQECNTNTSPFLPRFLETLSYYTAMFESIDVMLPRNHKERINIEQHCMARDVVNIIACEGAERIERHELLGKWKSRFSMAGFEPYPLSSIISATIRALLRDYSNGYAIEERDGALYLGWMDRILVSSCAWK

SEQ ID NO: 2713 - DNA, 627 bp, Arabidopsis thaliana
atgatgggataccaaacaaactctaatttctccatgtttttttcctcggaaaatgacgaccaaaaccaccacaactacgatccttataataatttctcttcatcaacttctgttgattgcactctctcacttggaacaccctctactcgtctcgacgaccaccatagattttcttctgctaattctaacaacatctccggcgacttttatattcacggaggaaacgctaagacttcttcgtacaagaagggtggtgttgctcatagcctacctcgccgttgtgctagctgcgacaccacttcaactcctctatggagaaacggaccaaaaggacctaagtcgttatgtaacgcgtgtggaatccgattcaagaaagaggagaggcgtgcgacggccagaaacttaacgatctccggtggaggttcatcagcggcagaagtcccagtagagaattcgtacaacggaggtggaaactattacagtcatcatcatcatcactatgcctcgtcgtcgccgtcgtgggctcatcagaacacacaaagagttccatatttctcaccggttccggagatggaatatccctacgtggataacgtcacggcttcttcttttatgtcttggaattga

SEQ ID NO: 2714 - protein, 208 aa, Arabidopsis thaliana
MMGYQTNSNFSMFFSSENDDQNHHNYDPYNNFSSSTSVDCTLSLGTPSTRLDDHHRFSSANSNNISGDFYIHGGNAKTSSYKKGGVAHSLPRRCASCDTTSTPLWRNGPKGPKSLCNACGIRFKKEERRATARNLTISGGGSSAAEVPVENSYNGGGNYYSHHHHHYASSSPSWAHQNTQRVPYFSPVPEMEYPYVDNVTASSFMSWN

SEQ ID NO: 2715 - DNA, 603 bp, Arabidopsis thaliana
atggccgcgtttccgcagtggacaagggtcgatgacaaacgttttgagttagctctgcttcaaatcccggagggttcgccgaattttatagagaatatcgcctattatctccagaaaccggtgaaggaggtggagtactactactgcgcgttggtccatgatattgagcggatcgaatcgggtaagtatgttttgcccaaatacccggaagacgattacgtgaaactgacggaagcaggtgagtctaagggcaatgggaaaaagacgggaattccttggtcagaagaggaacagaggttgtttctggaaggactaaataagtttgggaaaggagactggaagaacatatcgaggtattgtgtgaagtcaaggacctcgacgcaagtggcaagccatgctcagaagtattttgcaaggcaaaagcaggagagtacgaatactaaacgcccgagtattcatgacatgactctgggagttgcggtcaatgtccctggatccaacttggagtctactggccagcaaccacattttggtgatcaaattccttcgaatcaatattatccctcccaggaaaactttcggggttttgatcagcgatggtga

SEQ ID NO: 2716 - protein, 200 aa, Arabidopsis thaliana
MAAFPQWTRVDDKRFELALLQIPEGSPNFIENIAYYLQKPVKEVEYYYCALVHDIERIESGKYVLPKYPEDDYVKLTEAGESKGNGKKTGIPWSEEEQRLFLEGLNKFGKGDWKNISRYCVKSRTSTQVASHAQKYFARQKQESTNTKRPSIHDMTLGVAVNVPGSNLESTGQQPHFGDQIPSNQYYPSQENFRGFDQRW

SEQ ID NO: 2717 - DNA, 1170 bp, Arabidopsis thaliana
atgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctag

SEQ ID NO: 2718 - protein, 389 aa, Arabidopsis thaliana
MIVYGGGASEDGEGGGVVLKKGPWTVAEDETLAAYVREYGEGNWNSVQKKTWLARCGKSCRLRWANHLRPNLRKGSFTPEEERLIIQLHSQLGNKWARMAAQLPGRTDNEIKNYWNTRLKRFQRQGLPLYPPEYSQNNHQQQMYPQQPSSPLPSQTPASSFTFPLLQPPSLCPKRCYNTAFSPKASYISSPTNFLVSSPTFLHTHSSLSSYQSTNPVYSMKHELSSNQIPYSASLGVYQVSKFSDNGDCNQNLNTGLHTNTCQLLEDLMEEAEALADSFRAPKRRQIMAALEDNNNNNNFFSGGFGHRVSSNSLCSLQGLTPKEDESLQMNTMQDEDITKLLDWGSESEEISNGQSSVITTENNLVLDDHQFAFLFPVDDDTNNLPGIC

SEQ ID NO: 2719 - DNA, 578 bp, Arabidopsis thaliana
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 2720 - protein, 101 aa, Arabidopsis thaliana
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 2721 - DNA, 1484 bp, Arabidopsis thaliana
gaaaaagacttcactttttttttttactaattaattagtttttttttctcctttccaaaacaatggagaatttcgtcgacgagaatggttttgcttctctaaaccaaaacatcttcacacgtgatcaagaacacatgaaagaagaagattttccattcgaagtcgtcgaccaatcaaaacctacaagctttcttcaagattttcaccatcttgatcatgatcatcagtttgatcatcatcatcatcatggctcctcatcttcacatcctttgctcagcgtccaaactacgtcttcttgtatcaataatgctcctttcgagcattgctcttaccaagaaaacatggtcgatttctatgaaactaaaccaaatttgatgaatcatcatcatttccaagcagtggaaaactcatacttcactcgtaatcatcatcatcatcaagagatcaatttggtcgatgaacatgatgatcctatggacttggagcaaaacaacatgatgatgatgaggatgatcccttttgattaccctcctacagagactttcaaacctatgaacttcgtaatgccagatgaaatttcatgtgtttctgcagataatgattgttatagagcaacgagtttcaacaagaccaaaccatttcttacacgaaagttgtcttcttcttcttcatcatcatcatggaaagaaaccaaaaagtcaaccttagtcaaaggacaatggactgctgaagaagacagggtactgattcaactcgtggagaagtatggattgcgtaaatggtcgcatatcgctcaagtgttaccgggaagaatcgggaaacaatgtagagagaggtggcataaccatttgagacctgacattaagaaagaaacatggagtgaagaagaggacagagtgttgatagaatttcacaaagagattggaaacaaatgggcagagattgcgaaaagactcccgggaagaacagagaactcgatcaagaaccattggaacgcaacaaaaagaagacaattctctaaaagaaaatgtagatctaagtatccaagaccttctctgttgcaggattacatcaagagcttgaatatgggagctttgatggcttcttctgttcctgcaagaggtagacgcagagagagtaataacaagaagaaggatgttgttgttgcggttgaggagaagaagaaggaagaggaggtgtatggacaagacaggattgtgcctgaatgtgtgtttactgatgattttggattcaatgagaagctgcttgaggaaggatgtagcattgactctttgcttgatgacattcctcagcctgacattgatgcttttgttcatgggctctgatttgtattttttattctgcttgtttcagttttgttgttttttgtttgtctttttatacgagacagattccaccaaacttcaataatttgaaaagatataaaatattttgctttttaaaaaaaaaaaaaaaaaaaaaaa

SEQ ID NO: 2722 - protein, 427 aa, Arabidopsis thaliana
MENFVDENGFASLNQNIFTRDQEHMKEEDFPFEVVDQSKPTSFLQDFHHLDHDHQFDHHHHHGSSSSHPLLSVQTTSSCINNAPFEHCSYQENMVDFYETKPNLMNHHHFQAVENSYFTRNHHHHQEINLVDEHDDPMDLEQNNMMMMRMIPFDYPPTETFKPMNFVMPDEISCVSADNDCYRATSFNKTKPFLTRKLSSSSSSSSWKETKKSTLVKGQWTAEEDRVLIQLVEKYGLRKWSHIAQVLPGRIGKQCRERWHNHLRPDIKKETWSEEEDRVLIEFHKEIGNKWAEIAKRLPGRTENSIKNHWNATKRRQFSKRKCRSKYPRPSLLQDYIKSLNMGALMASSVPARGRRRESNNKKKDVVVAVEEKKKEEEVYGQDRIVPECVFTDDFGFNEKLLEEGCSIDSLLDDIPQPDIDAFVHGL

SEQ ID NO: 2723 - DNA, 1107 bp, Arabidopsis thaliana
ccattatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaatgaagcatgttcattttttcgctaaaaaaaaaaaaaaaaaaaaaaa

SEQ ID NO: 2724 - protein, 277 aa, Arabidopsis thaliana
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 2725 - DNA, 2000 bp, Arabidopsis thaliana
aggttagttctacacaaagcttgatcttttaggggttttctctagttattggagagtggtgagaattagaaactgcattatccgatctaaaatgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcagcgcgatatgatggggttgacaaatcagaacaatgagcttaagttccggcttcaagcaatggagcaacaagcgcgtcttcgcgatgctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatagagcagagaagttgttgcggtggatcaaagggttggagtttttcaacaagttacatatcaaatcaaacattatatttcatttatgtgcagagtcagttgaatttacatatatatcatataagtccaagaaatttaattttacaatatgttgttatcttagaaagaaaaaattcaatttatagtagatataggtatgaactatgaacacaagttatatgtaatgggattgattgagcttcagacaaaaa

SEQ ID NO: 2726 - protein, 553 aa, Arabidopsis thaliana
MGDTEKCNSDMIQRLHSSFGTTSSSIPKNPISQLDLNPNFIRSSAPQFSKPFSDSGKRIGVPPSHPNLIPPTSPFSQIPTTRQPGSHNFNPGGANHSRSMSQPNSFFSFDSLPPLSPSPFRDHDVSMEDRDSGVFNSNHSLPPSPFTRCNSTSSSSLRVGESLPPRKSHRRSNSDIPSGFNSMPLIPPRPLERSFSGGECADWSKSNPFVKKESSCEREGVGEREAMDDLFSAYMNLENIDVLNSSEADDSKNGNENRDDMESSRASGTKTNGSDTEGESSSVNESANNNMNSSGEKRESVKRRAAGGDIAPTTRHYRSVSVDSCFMEKLSFGDESLKPPPSPGSMSRKVSPTNSVDGNSGAAFSIEFNNGEFTAAEMKKIMANDKLAEMAMSDPKRVKRNDPLFRILANRQSAARSKERKMRYIVELEHKVQTLQTEATTLSAQLTLLQRDMMGLTNQNNELKFRLQAMEQQARLRDALNEALNGEVQRLKLAIGESSQNESERSKMQSLNAEMFQQLNISQLRQQPQQMQQQSHQQNHQNGTMATKSESNE

SEQ ID NO: 2727 - DNA, 1087 bp, Arabidopsis thaliana
aaaggagcattggtatctcaaacaatatttgccctttctctatctctctctcatcactatttgccatctctttctctctccctctctttcaaatgtcaataaaccaatactcaagcgatttccactaccattctctcatgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggggctcaagcggtggagagccaaagaggcaactcgaagacattaagactgttcggagtgaacatggagtgccagctagattcggactggtccgagccatccacacctgacggttctaacacatatacaaccaatcacgaccagtttcatttctaccctcaacaacaacactatcctcctccgtactacatggacataagtttcacaggagatatgaaccggacgagctagaagcccacaaggattaaaaaaaagcttcacatctggtcctgttatgttgtcatagatgttgattccttaattttacacaagcttcattttgcattatttaaagtaaaatcgtattttgattcttctttaaatctctctcaattttcactctcttcctttttcttcttatgtattagattcttttacatagctaacacttgtatagagaattcaaagttctggctattttcgaaagttatcttttctcttaaaaaaaaaaa

SEQ ID NO: 2728 - protein, 244 aa, Arabidopsis thaliana
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 2729 - DNA, 1308 bp, Arabidopsis thaliana
atgaaggacgcagagaagcgagaggtgattgcatcatcatcattacaaagaaagagaaacagaggaagaagactaaggaaaagaagaagaagaaacgagaagcgagtactaatggttccatcatcattaccaaacgacgtgctagaggagatctttttaagatttccggttaaagccctaatccgactcaagtctctctcgaaacaatggagatcgacgatcgaatctcgcagttttgaagagagacacttgacgatcgctaagaaagccttcgtggatcatcccaaggtcatgctcgtaggagaagaagatcccataagaggaaccgggattcgtccagacactgacattggttttaggttattctgcttggaatcggcttctcttctatcctttactcgtctcaatttccctcaagggttcttcaactggatctacatatctgaaagctgtgatggccttttctgcatccattccccaaaatcacattccgtatatgtagtgaatccggctacacggtggctccgcctacttcctccggcagggtttcagattttgatccacaagtttaaccccactgaacgtgagtggaatgtagtgatgaaatcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataa

SEQ ID NO: 2730 - protein, 435 aa, Arabidopsis thaliana
MKDAEKREVIASSSLQRKRNRGRRLRKRRRRNEKRVLMVPSSLPNDVLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREKDTMIQDIWRLKPSEDTWEKIFSIDLVSCPSSRTEKRDQFDWSKKDRVEPATPVAVCKNKKILLSHRYSRGLVKYDPLTKSIDFFSGHPTAYRKVIYFQSLISHL

SEQ ID NO: 2731 - DNA, 639 bp, Arabidopsis thaliana
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattga

SEQ ID NO: 2732 - protein, 212 aa, Arabidopsis thaliana
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 2733 - DNA, 969 bp, Arabidopsis thaliana
atgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaa

SEQ ID NO: 2734 - protein, 322 aa, Arabidopsis thaliana
MIGTSFPEDLDCGNFFDNMDDLMDFPGGDIDVGFGIGDSDSFPTIWTTHHDTWPAASDPLFSSNTNSDSSPELYVPFEDIVKVERPPSFVEETLVEKKEDSFSTNTDSSSSHSQFRSSSPVSVLESSSSSSQTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 2735 - DNA, 1226 bp, Arabidopsis thaliana
aagacataattttctctgttttcctagctctctcctctcaaattcttccattgctctctgttttggcaaatcgtgaactgccacgtctttaaggcatcagtgaagcaaagatggactttgacgaggagctaaatctttgtattacgaaaggtaaaaatgttgatcattcttttggaggagaagcttcttccacgtccccaagatctatgaagaaaatgaagagtcctagtcgtcctaaaccctatttccaatcctcttcttctccttattcgttagaggctttccctttttctctcgatccaacacttcagaatcagcaacaacaactcggatcatacgttccggtacttgagcaacgacaagacccgacaatgcaaggccagaagcaaatgatctcctttagtcctcaacaacaacaacagcagcagcagtatatggcccagtactggagtgacacattgaatctgagtccaagaggaagaatgatgatgatgatgagccaagaagctgttcaaccttacatcgcaacgaagctgtacagaggagtgagacaacgtcaatggggaaaatgggtcgcagagatccgtaagccacgaagcagggcacgtctttggcttggtacctttgatacagctgaagaagctgccatggcctacgaccgccaagccttcaaattacgaggccacagcgcaacactgaatttcccggagcattttgtgaataaggaaagcgagctgcatgattcaaactcgtcggatcagaaagaacctgaaacgccacagccaagcgaggttaacttggagagcaaggaactaccggtgattgatgttgggagagaggaaggtatggctgaggcatggtacaatgccattacatcgggatggggtcctgaaagtcctctttgggatgatttggatagttctcatcagttttcatcagaaagctcatcttcttctcctctctcttgtcctatgaggcctttcttttgaaaaagtttataaacccacattgtgttgtaggttatagtttagggttatgctcattggcatttggatggaggcaatttttgtgatctcccattccaccacatatcagtcattatatgtgtctaccttttctctgtatttctatcattatcattgtttttattatgtgtctgtatgtgtttccctattgctacatacatagatgtcctctttgttcaaaaaaaaaaaaaaaaaaaaaaa

SEQ ID NO: 2736 - protein, 292 aa, Arabidopsis thaliana
MDFDEELNLCITKGKNVDHSFGGEASSTSPRSMKKMKSPSRPKPYFQSSSSPYSLEAFPFSLDPTLQNQQQQLGSYVPVLEQRQDPTMQGQKQMISFSPQQQQQQQQYMAQYWSDTLNLSPRGRMMMMMSQEAVQPYIATKLYRGVRQRQWGKWVAEIRKPRSRARLWLGTFDTAEEAAMAYDRQAFKLRGHSATLNFPEHFVNKESELHDSNSSDQKEPETPQPSEVNLESKELPVIDVGREEGMAEAWYNAITSGWGPESPLWDDLDSSHQFSSESSSSSPLSCPMRPFF

SEQ ID NO: 2737 - DNA, 1860 bp, Arabidopsis thaliana
atgagaggttcttggtacaagagtgtttcctctgtttttggtctcagaccacggatcagagggttgttattcttcattgttggtgttgtggctctagttactattttagcaccattgacatctaattcgtatgattcttcgtcaagttcgacacttgtgccgaacatttatagtaactataggaggataaaggagcaagctgctgttgattatcttgatctgaggtctctttctttaggggctagtttaaaagagtttcctttttgtggtaaagaaagagaaagttatgtgccttgttataacataactgggaatttgcttgctgggcttcaagagggtgaggagttagatcgacattgcgagtttgaaagagagaaggaaagatgtgtagttcgtcctccgagagattataaaataccacttaggtggccacttggtagagatatcatatggagtgggaacgtgaagattaccaaagaccagtttctttcttcaggaactgtgacaacgaggttaatgttgcttgaagagaatcaaataacctttcactcggaggacggcctggtctttgatggggtcaaagactatgctcgtcaaattgctgagatgataggtttaggaagtgatactgaatttgctcaagcgggtgtacggactgtgttagacattggttgcggatttggtagctttggtgctcatttagtgtctttgaagctgatgcctatatgtattgctgagtatgaggcaactgggagccaagttcagttagctctagagagaggccttcctgcaatgattggcaatttcttttcaaaacagcttccttatccagcactgtcttttgatatggtccattgtgctcaatgtggcactacttgggatatcaaagatgcaatgctacttttggaagtggatcgtgttctgaaacccgggggatactttgttttaacttctcccacaaacaaagcacagggaaacttaccagataccaagaaaacgagcatctcaacacgggtgaatgagttatctaagaaaatctgttggagtctaacagctcagcaggatgagacgtttctttggcagaaaacttctgattcaagttgctattcttctcgttcgcaagcttctatacctctttgcaaagatggagatagcgttccgtattaccacccattggttccatgtataagcggaaccacgagtaaacgctggatttctatacagaacaggtctgctgttgcaggaacaacctctgccgggcttgaaattcatggtttaaaaccggaagaattcttcgaggatacacaaatatggagatcagctctgaaaaactattggtccttgcttacacctctaattttctctgaccatccgaagagacccggtgatgaggatcctctcccgcctttcaacatgatacgcaatgtgatggacatgcatgctcgttttgggaatttaaatgccgctttactcgacgaaggaaaatctgcttgggtaatgaacgtcgtcccagtcaatgcacgtaatactcttcctatcatacttgatcgtggtttcgccggtgttctacatgactggtgtgaaccattcccgacatatcctcgaacatatgacatgcttcatgccaatgaacttctcacacatcttagctcagaacgatgcagcctaatggacttgttcttggagatggaccggattcttcgccctgagggatgggttgttctaagcgacaaagtgggagtaatcgagatggctcgagcacttgcagctcgagtgcgttgggaagcaagagtcattgatcttcaagatggtagtgaccaaagacttctcgtctgtcaaaaaccattcatcaaaaaataa

SEQ ID NO: 2738 - protein, 619 aa, Arabidopsis thaliana
MRGSWYKSVSSVFGLRPRIRGLLFFIVGVVALVTILAPLTSNSYDSSSSSTLVPNIYSNYRRIKEQAAVDYLDLRSLSLGASLKEFPFCGKERESYVPCYNITGNLLAGLQEGEELDRHCEFEREKERCVVRPPRDYKIPLRWPLGRDIIWSGNVKITKDQFLSSGTVTTRLMLLEENQITFHSEDGLVFDGVKDYARQIAEMIGLGSDTEFAQAGVRTVLDIGCGFGSFGAHLVSLKLMPICIAEYEATGSQVQLALERGLPAMIGNFFSKQLPYPALSFDMVHCAQCGTTWDIKDAMLLLEVDRVLKPGGYFVLTSPTNKAQGNLPDTKKTSISTRVNELSKKICWSLTAQQDETFLWQKTSDSSCYSSRSQASIPLCKDGDSVPYYHPLVPCISGTTSKRWISIQNRSAVAGTTSAGLEIHGLKPEEFFEDTQIWRSALKNYWSLLTPLIFSDHPKRPGDEDPLPPFNMIRNVMDMHARFGNLNAALLDEGKSAWVMNVVPVNARNTLPIILDRGFAGVLHDWCEPFPTYPRTYDMLHANELLTHLSSERCSLMDLFLEMDRILRPEGWVVLSDKVGVIEMARALAARVRWEARVIDLQDGSDQRLLVCQKPFIKK

SEQ ID NO: 2739 - DNA, 1902 bp, Arabidopsis thaliana
atggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatgatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactag

SEQ ID NO: 2740 - protein, 633 aa, Arabidopsis thaliana
MAKENSGHHHQTEARRKKLTLILGVSGLCILFYVLGAWQANTVPSSISKLGCETQSNPSSSSSSSSSSESAELDFKSHNQIELKETNQTIKYFEPCELSLSEYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVKTYWTGQPSDKNNNNNNNNNN

SEQ ID NO: 2741 - DNA, 952 bp, Arabidopsis thaliana
aagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaatt

SEQ ID NO: 2742 - protein, 283 aa, Arabidopsis thaliana
MDTLSIKTYLLLSYTFNFPIQIPIFNLSFFFISLSLSLFMATRIPFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKPPPTQFTPNLFLDSSSRRRRSGYMDDFFSIEPSGSIKSCSGSAMEDNDDGSCRGINNEEKQPDRHCFILGTDLRTRERPLMLEEKLKQRDHDNEEEQGSKRFYRFLDEWPSSKSSVSTSLFI

SEQ ID NO: 2743 - DNA, 1107 bp, Arabidopsis thaliana
aaatgcccttagaggctgtcgtatacccgcaagatccattcggatatctctccaattgcaaagattttatgttccacgacttatactctcaagaagagttcgtagctcaagatacgaagaacaacattgataagttagggcatgaacagagctttgtggaacaaggtaaggaggacgatcatcaatggcgagactatcatcagtatcctttgttgatcccttcgttgggagaagagcttggtcttaccgccattgatgtggagagtcatcctcctccacagcaccggaggaagaggaggagaacgagaaactgcaagaacaaggaagagatcgagaaccagagaatgactcacatcgccgtcgagagaaatcgccggaaacagatgaacgagtatctggctgtgctccgttctctaatgccgtcgtcgtatgctcaaagaggagatcaagcgtcgatagtaggaggagctataaactacgtgaaggagttagagcatattttacaatctatggagccgaagagaactaggactcatgatcccaaaggagacaagactagcactagctcgttagtgggtccattcacagattttttcagcttcccacaatattctacaaagtcatcatcagatgtaccggaaagctcatcttcaccggcggagatagaggttacggtggcagaaagccatgcgaacatcaagataatgacgaagaagaaaccgaggcagcttcttaagctcataacttctttacaaagcctaaggctcactcttcttcatctcaatgtcaccactctccacaactccattctctactccatcagcgtcagggttgaagaaggaagccaactgaataccgtggacgacattgcaacagctttgaatcaaaccataaggaggattcaagaagagacataattcagcaaatagattataattaacttgttttatttttattttattttgaaataactgaaatcagttttctaattttttttttttttcactattcctctaatcctccctatgtaagttgcatttttgtctcttgtaatgaatcaatggtcataaagatctgaacaaaaaaattgaataaaagaaaatggtt

SEQ ID NO: 2744 - protein, 304 aa, Arabidopsis thaliana
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTSSLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEET

SEQ ID NO: 2745 - DNA, 519 bp, Arabidopsis thaliana
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaatag

SEQ ID NO: 2746 - protein, 172 aa, Arabidopsis thaliana
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 2747 - DNA, 1200 bp, Arabidopsis thaliana
atggttttttcttcatttcctacttatcctgatcattcatcaaactggcaacaacaacatcaaccaatcacaaccaccgttggattcacgggaaataacatcaaccaacagtttcttcctcaccatcccctcccaccgcaacagcaacaaacgcctccgcagcttcaccacaacaacggtaacggcggagtcgctgttcccggtggacctggcgggttaatccgaccaggttcgatggcggaaagagcaaggctagccaacataccattacctgaaacagccttgaagtgtccaagatgtgactcaactaacaccaaattctgttacttcaacaactacagtctcactcaacctcgccacttctgcaaagcatgccgtcgttactggacacgtggcggtgctctaaggagcgttcccgtcggtggcggttgccgtagaaacaaaagaaccaaaaacagcagcggtggaggtggcggtagcaccagtagcggtaacagcaagtcacaagacagcgccacgagcaacgaccaataccaccaccgagccatggctaacaatcagatgggaccaccttcttcgtcatcgtctctaagctcgttgctgtcttcttacaacgcagggttaatccccggacatgatcataacagcaataacaacaacatacttggacttggatcatctttgcctcctcttaagcttatgcctcctttagacttcacagacaacttcaccttacaatacggtgccgtttcagctccttcttatcatataggcggtggaagcagtggaggagcggcggctcttttaaacggttttgaccagtggagattcccggcaacaaaccaacttcctttaggcggtttagacccgtttgatcaacaacatcaaatggagcagcagaatccaggttacggattggttaccgggtcgggtcagtatcgacctaagaacattttccataaccttatctcctcttcttcgtctgcttcatcagctatggttacagccaccgcgtcgcaattagcttcagtgaaaatggaagatagtaacaatcagctcaacttgtctagacaactttttggagacgaacaacagctctggaatattcatggcgctgctgcagcatccaccgcagctgcaacaagttcgtggagtgaagtctctaataatttcagttcttcttctactagcaatatataa

SEQ ID NO: 2748 - protein, 399 aa, Arabidopsis thaliana
MVFSSFPTYPDHSSNWQQQHQPITTTVGFTGNNINQQFLPHHPLPPQQQQTPPQLHHNNGNGGVAVPGGPGGLIRPGSMAERARLANIPLPETALKCPRCDSTNTKFCYFNNYSLTQPRHFCKACRRYWTRGGALRSVPVGGGCRRNKRTKNSSGGGGGSTSSGNSKSQDSATSNDQYHHRAMANNQMGPPSSSSSLSSLLSSYNAGLIPGHDHNSNNNNILGLGSSLPPLKLMPPLDFTDNFTLQYGAVSAPSYHIGGGSSGGAAALLNGFDQWRFPATNQLPLGGLDPFDQQHQMEQQNPGYGLVTGSGQYRPKNIFHNLISSSSSASSAMVTATASQLASVKMEDSNNQLNLSRQLFGDEQQLWNIHGAAAASTAAATSSWSEVSNNFSSSSTSNI

SEQ ID NO: 2749 - DNA, 1110 bp, Arabidopsis thaliana
atggacgctacgaagtggacacagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtga

SEQ ID NO: 2750 - protein, 369 aa, Arabidopsis thaliana
MDATKWTQGFQEMMNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 2751 - DNA, 741 bp, Arabidopsis thaliana
atgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaa

SEQ ID NO: 2752 - protein, 246 aa, Arabidopsis thaliana
MMTSSHQSNTTGFKPRRIKTTAKPPRQINNKEPSPATQPVLKCPRCDSVNTKFCYYNNYSLSQPRHYCKNCRRYWTRGGALRNVPIGGSTRNKNKPCSLQVISSPPLFSNGTSSASRELVRNHPSTAMMMMSSGGFSGYMFPLDPNFNLASSSIESLSSFNQDLHQKLQQQRLVTSMFLQDSLPVNEKTVMFQNVELIPPSTVTTDWVFDRFATGGGATSGNHEDNDDGEGNLGNWFHNANNNALL

SEQ ID NO: 2753 - DNA, 920 bp, Arabidopsis thaliana
aggaaacataagtaatcgttgcttcgatcctttgttacatggatggatcctgaacaggaaatctcaaacgagactttggaaactatattggtaagttcaacaaaaggaagcaataataacaataagaaaatggaagaagaaatgaagaagaaagtatcaagaggagaattaggaggtgaagctcaaaattgtccaagatgtgaatctccaaacacaaagttttgttactacaacaactatagtctctcacaacctcgttacttctgcaaatcttgtcggagatattggactaaaggcggtactcttcgtaacgttcccgtcggtggtggttgccgtcgaaacaaacgatcctcttcctcagctttctccaagaacaacaacaataagtctattaatttccatactgatccacttcagaaccctttaattacgggaatgccaccatcatcttttggttatgatcactccattgatctcaacctcgctttcgctactctccaaaagcatcatttatcctctcaagctactacgccttcttttgggtttggaggtgatctttctatttatggaaactcaacgaatgatgtagggatcttcggagggcaaaacggtacttataacaatagtttgtgttatgggtttatgtccggaaatggtaataataatcaaaatgaaatcaagatggcttctacattggggatgtctttggaaggaaacgagagaaagcaagagaatgtgaacaataacaataataactcagagaatcctagcaaggtgttctgggggtttccatggcagatgaccggagattccgccggagttgtaccggagattgatcccggaagggaaagctggaatgggatggtttcatcttggaataatggtttactcaacactcctttggtctagcagatcattaa

SEQ ID NO: 2754 - protein, 288 aa, Arabidopsis thaliana
MDPEQEISNETLETILVSSTKGSNNNNKKMEEEMKKKVSRGELGGEAQNCPRCESPNTKFCYYNNYSLSQPRYFCKSCRRYWTKGGTLRNVPVGGGCRRNKRSSSSAFSKNNNNKSINFHTDPLQNPLITGMPPSSFGYDHSIDLNLAFATLQKHHLSSQATTPSFGFGGDLSIYGNSTNDVGIFGGQNGTYNNSLCYGFMSGNGNNNQNEIKMASTLGMSLEGNERKQENVNNNNNNSENPSKVFWGFPWQMTGDSAGVVPEIDPGRESWNGMVSSWNNGLLNTPLV

SEQ ID NO: 2755 - DNA, 750 bp, Arabidopsis thaliana
atggataacttgaatgttttcgcaaatgaagacaatcaagtgaatgatgtgaagcccccaccaccaccacctcgagtgtgtgcaaggtgtgattctgataatactaaattttgttattacaacaactactgtgagtttcagccacgatacttctgcaagaactgtcgtagatactggactcatggtggggctttaagaaacataccaattggtggaagtagtcgtgccaaacgggcaagggtaaatcaaccttcggttgctcggatggtttctgttgagacccaacgaggtaacaatcaacctttctctaatgttcaagaaaacgttcatcttgttggatcttttggtgcttcatcttcatcttctgttggtgctgttgggaacctttttggttctttgtatgatattcatggtggtatggtaacaaatttgcatccaactcgaactgttcgaccaaatcatcgcttagctttccatgatggatcatttgagcaagactattacgatgttgggtccgataatcttttggtcaaccaacaagttggtggctacggttatcacatgaatccagtggatcaattcaagtggaaccagagcttcaacaacactatgaacatgaattataataacgatagcactagtggaagtagcagaggatctgacatgaatgtgaaccatgataacaagaagatcagataccgcaactctgtgattatgcatccttgtcatctggagaaggatggtccttga

SEQ ID NO: 2756 - protein, 249 aa, Arabidopsis thaliana
MDNLNVFANEDNQVNDVKPPPPPPRVCARCDSDNTKFCYYNNYCEFQPRYFCKNCRRYWTHGGALRNIPIGGSSRAKRARVNQPSVARMVSVETQRGNNQPFSNVQENVHLVGSFGASSSSSVGAVGNLFGSLYDIHGGMVTNLHPTRTVRPNHRLAFHDGSFEQDYYDVGSDNLLVNQQVGGYGYHMNPVDQFKWNQSFNNTMNMNYNNDSTSGSSRGSDMNVNHDNKKIRYRNSVIMHPCHLEKDGP

SEQ ID NO: 2757 - DNA, 951 bp, Arabidopsis thaliana
atgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttga

SEQ ID NO: 2758 - protein, 316 aa, Arabidopsis thaliana
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSMNTLPSSSSSQRFFSSIMEDSSKFFPPPTTMDFQLAGLSLNKMNDLQLLNNQEVLDLRPMMSSGRENTPVDVGSGLSLMGFGDFNNNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 2759 - DNA, 678 bp, Arabidopsis thaliana
atgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtga

SEQ ID NO: 2760 - protein, 225 aa, Arabidopsis thaliana
MPSEFSESRRVPKIPHGQGGSVAIPTDQQEQLSCPRCESTNTKFCYYNNYNFSQPRHFCKSCRRYWTHGGTLRDIPVGGVSRKSSKRSRTYSSAATTSVVGSRNFPLQATPVLFPQSSSNGGITTAKGSASSFYGGFSSLINYNAAVSRNGPGGGFNGPDAFGLGLGHGSYYEDVRYGQGITVWPFSSGATDAATTTSHIAQIPATWQFEGQESKVGFVSGDYVA

SEQ ID NO: 2761 - DNA, 630 bp, Arabidopsis thaliana
atgccgtcggaaccaaaccaaacccgacccaccagagttcagccctcaacggcggcttacccaccgccaaatctggctgagcctcttccttgtcctcgctgcaactccaccaccaccaagttctgttactacaacaactataacctcgctcagcctcgctactactgcaaatcttgccgccgttactggactcaaggtggtacactccgtgacgtccccgtcggtggtggaactcgtcgaagctcctcaaaacgtcaccgttctttctccaccactgccacctcctcttcctcctcttcttccgtcatcaccaccacgacacaagaaccagccacgactgaagcgagtcaaactaaggttactaatttaatttcaggtcatggaagctttgcttctctgttaggtttaggaagtggaaatggtgggttggattacgggtttgggtacgggtacgggcttgaggagatgagtattgggtatcttggagattcttccgtaggagagattccggtggttgatggttgtggtggtgacacgtggcagattggggagattgaaggtaaaagtggaggagacagtttgatatggcctggtcttgagatctcaatgcaaaccaacgatgttaagtga

SEQ ID NO: 2762 - protein, 209 aa, Arabidopsis thaliana
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTATSSSSSSSVITTTTQEPATTEASQTKVTNLISGHGSFASLLGLGSGNGGLDYGFGYGYGLEEMSIGYLGDSSVGEIPVVDGCGGDTWQIGEIEGKSGGDSLIWPGLEISMQTNDVK

SEQ ID NO: 2763 - DNA, 897 bp, Arabidopsis thaliana
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 2764 - protein, 298 aa, Arabidopsis thaliana
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 2765 - DNA, 924 bp, Arabidopsis thaliana
atgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttga

SEQ ID NO: 2766 - protein, 307 aa, Arabidopsis thaliana
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 2767 - DNA, 795 bp, Arabidopsis thaliana
atggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaa

SEQ ID NO: 2768 - protein, 264 aa, Arabidopsis thaliana
MVERARIAKVPLPEAALNCPRCDSTNTKFCYFNNYSLTQPRHFCKTCRRYWTRGGSLRNVPVGGGFRRNKRSKSRSKSTVVVSTDNTTSTSSLTSRPSYSNPSKFHSYGQIPEFNSNLPILPPLQSLGDYNSSNTGLDFGGTQISNMISGMSSSGGILDAWRIPPSQQAQQFPFLINTTGLVQSSNALYPLLEGGVSATQTRNVKAEENDQDRGRDGDGVNNLSRNFLGNININSGRNEEYTSWGGNSSWTGFTSNNSTGHLSF

SEQ ID NO: 2769 - DNA, 828 bp, Arabidopsis thaliana
atgggtggatcgatggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtga

SEQ ID NO: 2770 - protein, 275 aa, Arabidopsis thaliana
MGGSMAERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDLL

SEQ ID NO: 2771 - DNA, 744 bp, Arabidopsis thaliana
atggagagagcagaggccttgacatcatcgtttatatggcggccaaacgcaaacgcaaacgcggagatcacgccgagttgtccaagatgtggatcctctaacacaaagttctgttactacaacaactatagcctcactcagcctcgctacttctgcaaaggctgccgcagatattggaccaaaggtggttccctccgcaatgttcctgtaggcggtggctgtcgaaaatcccgccgccccaaatcatcttctggtaacaatactaaaactagcctaaccgctaattctggcaaccccggtggtggttcaccaagcatcgatcttgctcttgtttacgccaatttcttgaatccaaagcctgacgaatctatactacaagaaaattgcgacttagccactacggattttttggtagataatcctaccggcacttccatggacccttcatggagtatggacatcaatgatggtcatcatgatcattatattaatccggtggaacacattgtggaggaatgtggttataatggcttgcctccatttcctggtgaagagcttctctctttagacactaatggtgtttggtctgatgctttgttgattggtcataaccatgtagacgttggcgtgactccggttcaggctgtacacgaaccggtggttcatttcgctgacgaatccaatgattccaccaatctcttgtttggaagttggagcccttttgatttcactgccgatggatga

SEQ ID NO: 2772 - protein, 247 aa, Arabidopsis thaliana
MERAEALTSSFIWRPNANANAEITPSCPRCGSSNTKFCYYNNYSLTQPRYFCKGCRRYWTKGGSLRNVPVGGGCRKSRRPKSSSGNNTKTSLTANSGNPGGGSPSIDLALVYANFLNPKPDESILQENCDLATTDFLVDNPTGTSMDPSWSMDINDGHHDHYINPVEHIVEECGYNGLPPFPGEELLSLDTNGVWSDALLIGHNHVDVGVTPVQAVHEPVVHFADESNDSTNLLFGSWSPFDFTADG

SEQ ID NO: 2773 - DNA, 945 bp, Arabidopsis thaliana
atggagagatacaagtgtagattttgcttcaagagcttcatcaatggaagagctttaggtggtcacatgagatctcacatgcttactctttctgcagaacgttgtgtaataactggtgaagcagaagaagaagtagaggaacggccgagtcaactctgtgacgacgacgacgataccgagtccgatgcttcttcttcttctggtgagtttgataatcaaaagatgaatcgtcttgatgatgaattggagtttgatttcgctgaagacgacgacgttgaaagtgaaaccgagtcgtccaggattaacccaactcggcgacgatctaaacgaactcggaaacttggatcgtttgatttcgactttgagaagctaacaacgagccaacccagtgagttagtggccgagccagagcatcacagctcagcttctgatacaacaacggaggaagatctcgccttttgtctcattatgctgtccagagacaaatggaagcaacagaagaagaagaagcaacgtgtagaagaagatgagacagatcatgacagtgaagattacaaatcaagcaagagcagagggagattcaagtgtgagacttgtggtaaagtgtttaaatcgtatcaagcattaggaggacacagagcaagccacaagaagaacaaggcatgcatgacgaaaacagagcaagttgaaacagagtacgttcttggagtaaaggagaagaaagttcatgaatgtccgatctgttttagggtttttacttcagggcaagcacttggaggtcataagagatctcacggaagtaacatcggagcaggaagaggattgtcagtaagtcaaattgtccaaatcgaagaagaagtatcagtgaaacagaggatgattgatcttaatcttcctgcacctaatgaagaagatgaaacttctttggtgtttgatgaatggtga

SEQ ID NO: 2774 - protein, 314 aa, Arabidopsis thaliana
MERYKCRFCFKSFINGRALGGHMRSHMLTLSAERCVITGEAEEEVEERPSQLCDDDDDTESDASSSSGEFDNQKMNRLDDELEFDFAEDDDVESETESSRINPTRRRSKRTRKLGSFDFDFEKLTTSQPSELVAEPEHHSSASDTTTEEDLAFCLIMLSRDKWKQQKKKKQRVEEDETDHDSEDYKSSKSRGRFKCETCGKVFKSYQALGGHRASHKKNKACMTKTEQVETEYVLGVKEKKVHECPICFRVFTSGQALGGHKRSHGSNIGAGRGLSVSQIVQIEEEVSVKQRMIDLNLPAPNEEDETSLVFDEW

SEQ ID NO: 2775 - DNA, 945 bp, Arabidopsis thaliana
atggaagaaaatcttcctccggggttcagatttcatcctacagacgaggagctcataacgcattatctatgtcggaaagtctccgatataggattcaccggtaaagctgtcgtcgacgttgatctcaacaagtgtgaaccttgggatttgccagccaaggcttcaatgggagagaaagagtggtatttcttcagccaaagggatcggaaatatccaaccggtttaagaacaaaccgggcaacagaagctggttactggaaaaccaccgggaaagataaagaaatataccgaagtggagtgttggttgggatgaagaaaaccctagttttctacaaaggaagagctcccaaaggtgagaaaagcaattgggttatgcatgagtacaggcttgagagcaaacaacctttcaaccccacgaataaggaggaatgggtagtgtgtagggttttcgaaaagagcacggcagcaaagaaagcacaagaacaacaacctcaatcttctcaaccatcttttggatctccatgcgatgcaaactcatcaatggcaaatgagtttgaagatattgatgagcttccgaatctgaattcaaactcatcaaccatcgattacaataatcatatccatcaatattcgcaacgcaatgtttactcagaagacaacacaacaagtacggctggtctcaacatgaacatgaacatggctagtactaatcttcagtcttggacaacaagtctccttggtccgcctttatctccaatcaactctttgttgctcaaggctttccaaatcaggaactcttatagtttcccaaaagagatgatccccagtttcaatcattcttctcttcaacaaggagtctccaatatgatccaaaatgcttcaagttcgtctcaagtgcaaccccaaccgcaagaggaagcgtttaatatggactccatatggtga

SEQ ID NO: 2776 - protein, 314 aa, Arabidopsis thaliana
MEENLPPGFRFHPTDEELITHYLCRKVSDIGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVFEKSTAAKKAQEQQPQSSQPSFGSPCDANSSMANEFEDIDELPNLNSNSSTIDYNNHIHQYSQRNVYSEDNTTSTAGLNMNMNMASTNLQSWTTSLLGPPLSPINSLLLKAFQIRNSYSFPKEMIPSFNHSSLQQGVSNMIQNASSSSQVQPQPQEEAFNMDSIW

SEQ ID NO: 2777 - DNA, 658 bp, Arabidopsis thaliana
atcaatggaaggggttgacaacacaaatcctatgttaaccctagaagaaggcgaaaacaacaatcctttttcttccttagatgacaaaacattaatgatgatggctccttcgttaatcttttcgggcgatgtaggtccatcttcttcttcttgtactccagcaggttatcatctatctgctcagctggagaactttcgaggaggtggaggagagatgggaggattagtgagtaataatagcaataatagtgatcataataagaattgcaacaaaggaaaagggaagagaactttggcaatgcagaggatagcttttcatacaaggagtgatgatgatgttcttgatgatggttatcgttggcgaaagtacggtcagaaatctgtcaagaacaatgctcatcccaggagctattatagatgtacataccacacatgcaacgtgaagaaacaagtgcaaagactggcaaaagatccaaacgttgtcgtaacaacctacgaaggtgttcataatcatccttgtgagaagctcatggagactcttagccctctccttaggcaacttcagttcctctcaagagtttctgatctgtaattattgaatgttaattagtggtgtaatacattaattatgctttaatctctccattgaccctcaatc

SEQ ID NO: 2778 - protein, 195 aa, Arabidopsis thaliana
MEGVDNTNPMLTLEEGENNNPFSSLDDKTLMMMAPSLIFSGDVGPSSSSCTPAGYHLSAQLENFRGGGGEMGGLVSNNSNNSDHNKNCNKGKGKRTLAMQRIAFHTRSDDDVLDDGYRWRKYGQKSVKNNAHPRSYYRCTYHTCNVKKQVQRLAKDPNVVVTTYEGVHNHPCEKLMETLSPLLRQLQFLSRVSDL

SEQ ID NO: 2779 - DNA, 1451 bp, Arabidopsis thaliana
aattgagattaaagtaatttatctttcagaaaatggcggttgaagacgatgtatctttgataagaacgacgacgttagtggcaccaacaagacccacgattacagttcctcatagacctccggcgatcgaaacggcggcgtatttctttggcggtggagatgggcttagtctaagcccagggccactttcttttgtctcttctttgtttgttgataacttccctgacgtcttgacgccggataaccaacggacgacgtcgtttactcagcttcttaacggaactatgtcggtgtctcctggtggcggaggacgttcaacggcggggatgttcgccggaggaggtccgatgtttacaatcccttctggtttcagcccttctagtcttctcacctcgcccatgttctttcccccgcagtcgtcagctcataccggctttattcaaccacggcagcagtcacaaccgcaaccacaacgaccagacacgtttcctcaccatatgccaccatcgacatccgtcgccgtccatggtcgtcaatctttagacgtttcacaagtagatcaaagagctcgaaaccattataataatccggggaataacaataataaccggtcgtataacgttgtgaacgttgataaaccggcggatgacggttataactggaggaagtacggacaaaagcctatcaaagggtgtgaatatccaaggagttattacaaatgtacacatgttaactgtccggtgaagaagaaagtcgaacggtcatcggatggacagatcactcagatcatttacaaaggtcaacatgatcacgagaggcctcagaatcgccgtggcggtggaggcagagattccactgaggttggtggtgcagggcaaatgatggaatctagtgatgatagtggttatcgtaaggatcatgatgatgatgatgatgatgatgaagatgatgaagatcttccggcttcaaagataagaagaatagacggtgtgtcgacgactcaccggacggtgaccgagcctaagattatcgttcagacaaaaagtgaagtcgatcttctcgacgatggctataggtggcgtaagtacggacaaaaagttgtcaaaggaaatccccatccaaggagctattataaatgtacaacgccaaattgtacggtccgtaaacatgtagagagagcttccacggatgctaaggctgtgattacaacttacgaaggtaaacacaatcacgatgtccctgccgctagaaacggtaccgcggcagcaaccgcagctgcggtggggccgtctgaccaccatcgtatgagatcaatgtcggggaacaatatgcaacaacatatgagtttcggtaacaataataacacaggccaatctccggttcttttgaggttgaaagaagagaaaatcacaatttgacttttaagaaccaaagatttcgagattgatatt

SEQ ID NO: 2780 - protein, 461 aa, Arabidopsis thaliana
MAVEDDVSLIRTTTLVAPTRPTITVPHRPPAIETAAYFFGGGDGLSLSPGPLSFVSSLFVDNFPDVLTPDNQRTTSFTQLLNGTMSVSPGGGGRSTAGMFAGGGPMFTIPSGFSPSSLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 2781 - DNA, 1172 bp, Arabidopsis thaliana
aatcattagcttcttctcttctcttctctcacagagagagtaatcacaagccaagtgagaaaaagaaaacactaaacccagatcgaaaaccatgtctattaacaacaacaacaacaacaacaacaataacaacgatggtcttatgatctcatcaaacggagctttaatcgaacaacaaccatcagtcgttgtgaagaaaccaccggcgaaagatcgacatagcaaagtcgatggaagagggagaagaatccgtatgccgattatatgtgctgctcgtgtttttcagctaacgagagagcttggtcataagtcagatggccaaacaattgaatggttacttcgtcaagcagagccttctattatagctgcaacaggaactggtacaactccagcgagtttctcaactgcttctgtctctatccgtggagccaccaattctacttctttagatcataaacccacttctttacttggtggtacgtcaccgtttatacttgggaaacgtgttagagctgatgaggatagtaataatagtcataatcatagttctgttggtaaagatgagacctttacgacaacaccagctgggttttgggctgttccggcgaggccggattttggacaagtttggagttttgctggagctccacaagagatgtttttacaacaacaacatcatcatcagcaaccattgtttgttcatcagcaacagcaacaacaagctgcaatgggtgaagcttctgctgctagagttgggaattatcttccgggtcatcttaatttgcttgcttctttatccggtggatctcccgggtcggatcgaagagaggaagatccacgttaatggtttaagcccttttaggtttgagggcaaaatttggtatatatatttattatcttctcttctctattgttgtcattgtttctctatgtgtgtgttttagtgttgttagagattgatttggtttcagaatctctgcaagtgatttgagagttttcgttagctttaagtaagttaaagacggttgtttttgattagggttaaattagggtttaagaatctgttgtttttttggagggagatcgatttcttatcggatccaagattacttttaggaaaaaagggaaaatttcagaaaccacggtggtttcttttcctctttttttttttg

SEQ ID NO: 2782 - protein, 250 aa, Arabidopsis thaliana
MSINNNNNNNNNNNDGLMISSNGALIEQQPSVVVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEDSNNSHNHSSVGKDETFTTTPAGFWAVPARPDFGQVWSFAGAPQEMFLQQQHHHQQPLFVHQQQQQQAAMGEASAARVGNYLPGHLNLLASLSGGSPGSDRREEDPR

SEQ ID NO: 2783 - DNA, 2245 bp, Arabidopsis thaliana
acatttgtttctaatctcagacataaataatttttgttcccgacttcaaaaccaacgatgattatatcattccacattcattttcttctacttcttccttctccttgatctcatttccctagaaaatccatctatcatgggtgaagatgatatagtggagctcttatggaagagtggccaagtcgttagaaccagtcaaacacagagaccctcctccaatacaccaccatctcttcctccaccacccattcttcgtggtagcggaagcggcaacggagaagaaaatgccccgcttccacttccacagccttcacctcccctccatcatcagaatcttttcattctggaagacgaaatgtcttcttggcttcaccattctcaccccggcgttacgtccaccccggcttcttctgtctccctgccaccaccacccaatgctccgcgtgaagatgatatagtggagcttttatggcaaagcggccaagtagttggaaccaaccaaacacatagacaatcctacgatcctcctcccattctccgcggcagcggaagtggcagaggagaagaaaatgctcccctttcacaacctccgcctcacctgcatcagcaaaatctcttcattcaagaaggcgaaatgtattcgtggctacaccattcttaccgccaaaactatttctgctcagaacttctcaactccactccggctactcacccgcaaagttccatctctctggcaccacgtcagactatcgccacgagaagggcggaaaactttatgaacttctcgtggctaagagggaacatatttaccggcggtagagttgatgaagctggaccgtcgttttcggtggtaagagaatcgatgcaggtaggctcgaacacgacccccccttcttcttctgccactgaatcatgtgtaataccagctacagagggcaccgcgagtcgagtgtcgggaactttggcagctcatgatcttggtcggaagggaaaggcggtggcggttgaggcggccggaacaccatcttcaggagtgtgcaaggccgaaacagagccggttcagatacaaccagcaacggagtcgaagctaaaagcgagagaagaaacccatggaactgaagaagctcgtggttcaacgtctagaaagagatcacgaactgcagaaatgcataacctcgccgaaaggagaaggagagaaaagatcaacgagaagatgaagactctgcaacaactcattcctcgctgcaacaaggttgaatctgattctgtttctactctgatcagtctactaaagtttcaacgctggatgatgctatcgagtacgtcaaatcgttacagagccaaatacaagtatgctcttcaaaacagaatgtgttttaaaccaatggttcaacatggaaagagttcatatgtatctagttttgttgagatgatgtcgacgggacagggtatgatgtcgccaatgatgaatgccgggaatacgcaacagttcatgccccatatggccatggatatgaaccgacctcctccattcatacctttccccggcacatcttttcctatgccggctcaaatggcaggtgtaggtccatcatatccagcaccgcgctacccttttcccaacattcagacctttgacccatccagagtccgtttaccaagcccgcagcctaacccggtgtcgaaccagcctcagtttccggcttacatgaatccctatagccagtttgctggtccccaccagttgcaacaacctcctcctcctccatttcagggtcaaacaacatcacaactgagttccgggcaggcaagtagtagcaaggaacctgaggatcaggagaaccaaccaacagcttagttaaagtgtggagctgaaacggatcagttcttcaagcaaattacaactttgaagataaaccagagttgtaacatgtagattttgtctgttaagtttaatgtaagtactttttagttaatgggaaagatactgacaggttgcaaggtggtcagtatttgtgcatcacgcttaagattcctcgatgtggccagtatctcccttttctagcatgtgaggtccctactctctggttctacggagaccaaatgttcgactgattaaacacacaatgacttaccaaaagtacacgcggcccatcctcgtctttatgttccaagtgcgactgtttgtttatttgtaagcatttttcttataataataaaacagctctatcttcgttaaaaaaaa

SEQ ID NO: 2784 - protein, 573 aa, Arabidopsis thaliana
MGEDDIVELLWKSGQVVRTSQTQRPSSNTPPSLPPPPILRGSGSGNGEENAPLPLPQPSPPLHHQNLFILEDEMSSWLHHSHPGVTSTPASSVSLPPPPNAPREDDIVELLWQSGQVVGTNQTHRQSYDPPPILRGSGSGRGEENAPLSQPPPHLHQQNLFIQEGEMYSWLHHSYRQNYFCSELLNSTPATHPQSSISLAPRQTIATRRAENFMNFSWLRGNIFTGGRVDEAGPSFSVVRESMQVGSNTTPPSSSATESCVIPATEGTASRVSGTLAAHDLGRKGKAVAVEAAGTPSSGVCKAETEPVQIQPATESKLKAREETHGTEEARGSTSRKRSRTAEMHNLAERRRREKINEKMKTLQQLIPRCNKVESDSVSTLISLLKFQRWMMLSSTSNRYRAKYKYALQNRMCFKPMVQHGKSSYVSSFVEMMSTGQGMMSPMMNAGNTQQFMPHMAMDMNRPPPFIPFPGTSFPMPAQMAGVGPSYPAPRYPFPNIQTFDPSRVRLPSPQPNPVSNQPQFPAYMNPYSQFAGPHQLQQPPPPPFQGQTTSQLSSGQASSSKEPEDQENQPTA

SEQ ID NO: 2785 - DNA, 1750 bp, Arabidopsis thaliana
atttatgacttctcaatacaaaaagctcccctcacttttttaagttttgtcttctctaatccgtcttcttctactatcttgcatgtcttgcgtcttttatatacatctctcgtaaaccctagcaaatcatacaaggtcaagaagcttgaccttcattagacttaagcagtttataatcaactaccacgaatagcaatggataaagattactcggcaccaaacttcttaggtgaatcctcaggcggtaacgatgataacagctctggtatgatagactatatgttcaatagaaaccttcaacaacaacaaaagcaatcgatgccacaacagcagcaacatcaactctctccttccggatttggagcaacaccctttgataaaatgaacttctctgatgtgatgcagtttgcggacttcggttcgaaacttgcgttgaaccagaccagaaaccaagacgatcaagaaaccgggattgaccccgtttatttcttgaagttccctgtcttgaacgacaaaatagaggaccataaccaaacccaacatctcatgccttctcatcagacgtctcaagaaggaggtgagtgtggaggaaacataggcaatgtgtttcttgaagaaaaagaagatcaagacgatgacaacgacaacaactccgtgcaactacgttttattggaggagaagaagaagatagggagaacaagaatgttacgaaaaaggaggtgaagagcaagaggaagagagctagaacgagcaagaccagcgaagaagtggaaagccaacggatgactcatatcgcggtcgaaagaaaccgtaggaagcaaatgaatgagcatcttcgtgtccttagatctctcatgcctggctcctacgttcaaaggggagaccaagcgtcaatcataggaggagcaatagagtttgtgagagagctcgagcaactcctacaatgtcttgaatcacagaagcgtcgaagaatcttaggagaaaccggtagggacatgacaacgacaacgacttcttcttcttctcccataactacggtagcgaaccaagcacaaccgctcattattacgggaaatgtaaccgagctagagggcggaggagggcttcgggaggagactgcggagaacaagtcgtgcttggctgacgtggaggtgaagctgctagggtttgacgccatgatcaagatactttcaagaagaaggccgggacagctgattaagactatagctgctttggaggatcttcatctctctattcttcacactaacatcactaccatggaacaaaccgtcctctactcctttaatgtcaagataacaagtgaaacgaggtttacggcagaagacatagcaagttccatccaacagatatttagtttcattcatgcaaataccaacatatctggaagctctaacctgggaaatattgtgtttacttgaaaatcatcacacggcgacaactttgtacactggtgaagattacagtacgtaataatctctacatattgggttttattctccaagcatttggaagagtgtttaagttaaagggagtgcttactttatttttttggggcttttttcatgcaatttaaattttagtgatgattgtgtcgcttgtaatgttagaactcgttgttgtgatttctgctgctttgatttgtaggttttgaacaagcggtttagaatgctaaaccacttatttacttgaaataacttttttcacaaaaaaaaaaaaaaaagaaaaaaa

SEQ ID NO: 2786 - protein, 414 aa, Arabidopsis thaliana
MDKDYSAPNFLGESSGGNDDNSSGMIDYMFNRNLQQQQKQSMPQQQQHQLSPSGFGATPFDKMNFSDVMQFADFGSKLALNQTRNQDDQETGIDPVYFLKFPVLNDKIEDHNQTQHLMPSHQTSQEGGECGGNIGNVFLEEKEDQDDDNDNNSVQLRFIGGEEEDRENKNVTKKEVKSKRKRARTSKTSEEVESQRMTHIAVERNRRKQMNEHLRVLRSLMPGSYVQRGDQASIIGGAIEFVRELEQLLQCLESQKRRRILGETGRDMTTTTTSSSSPITTVANQAQPLIITGNVTELEGGGGLREETAENKSCLADVEVKLLGFDAMIKILSRRRPGQLIKTIAALEDLHLSILHTNITTMEQTVLYSFNVKITSETRFTAEDIASSIQQIFSFIHANTNISGSSNLGNIVFT

SEQ ID NO: 2787 - DNA, 1116 bp, Arabidopsis thaliana
cgtcgactgtccataaatccggagcctgacccgacgtttgacccggatccgaaactcccacaatctccataccacccaaattcatctcccctaaagctttctctcactttcccgggaaaatcggcgaccaaaattggaaaatgtactcagcgattcgctcgcttccactcgatggtggacacgttggtggtgactaccatggacctcttgacggaaccaatcttcccggtgacgcttgtttggttttaacgactgaccctaaacctcgtctccggtggacaactgagcttcatgagagattcgttgacgccgttactcagctcggtggtcctgacaaagcgactcccaaaactattatgagaacaatgggagtgaagggtctcactctctaccacctcaaatcacatcttcagaaattccgcctagggaggcaagctggcaaagaatcaactgagaactctaaagatgcttcttgtgtaggggagagtcaggacacaggttcatcttcgacatcatcaatgagaatggcgcagcaggagcagaacgagggttaccaagtcaccgaagctctacgtgctcagatggaagtccaaagaagactacacgatcaattggaggtgcaacggaggctccagctgaggatagaggcacaaggaaaatacctgcaatcgattcttgaaaaagcttgcaaggcctttgacgagcaagctgctacttttgctggacttgaggctgctagggaagagctatcagagctagccatcaaagtctccaatagctctcaaggaacatcagtcccgtacttcgatgcaacaaagatgatgatgatgccatcgttgtcagagcttgcagtagcaatagacaacaaaaacaacatcacaaccaactgttcagtagaaagctctctgacttccatcacacatgggagctctatatctgctgcatcaatgaagaagcgtcaacgtggagacaatttgggcgtagggtatgaatcaggctggattatgcctagtagcaccattggataaagtttaggagagggaaaaagttcattatgggaaaggtagagataagatttaactgttctttacttgctttgaggggcctgcggccgct

SEQ ID NO: 2788 - protein, 295 aa, Arabidopsis thaliana
MYSAIRSLPLDGGHVGGDYHGPLDGTNLPGDACLVLTTDPKPRLRWTTELHERFVDAVTQLGGPDKATPKTIMRTMGVKGLTLYHLKSHLQKFRLGRQAGKESTENSKDASCVGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 2789 - DNA, 609 bp, Arabidopsis thaliana
atggataacttcaatgttgttgccaatgaagacaatcaagtgaatgatgtgaagcctccaccacccccaccgcgagtgtgtgcaagatgtgattctgataacacaaaattttgttactacaacaattatagtgagtttcaaccgcgctacttctgcaagaactgtcgaagatactggactcatggtggggctttaagaaacgtaccaattggtgggagtagtcgtgccaagcggacaaggataaatcaaccttcagttgctcagatggtttctgttggaatccaaccagggaaccgttttagttctttgtctcatattcatggtggtatggtaacaaatgtgcatccaactcaaacttttcgaccaaatcatcgcctagctttccataatggatcatttgagcaagattattatgatgttgggtctgataatcttttggtaaaccaacaagttggtggatatgttgataatcacaacggttatcacatgaatcaagtggatcaatacaactggaaccagagcttcaataacgctatgaacatgaattataataacgctagcactagcggaaggatgcatcctagtcatttagagaagggtggtccttga

SEQ ID NO: 2790 - protein, 202 aa, Arabidopsis thaliana
MDNFNVVANEDNQVNDVKPPPPPPRVCARCDSDNTKFCYYNNYSEFQPRYFCKNCRRYWTHGGALRNVPIGGSSRAKRTRINQPSVAQMVSVGIQPGNRFSSLSHIHGGMVTNVHPTQTFRPNHRLAFHNGSFEQDYYDVGSDNLLVNQQVGGYVDNHNGYHMNQVDQYNWNQSFNNAMNMNYNNASTSGRMHPSHLEKGGP

SEQ ID NO: 2791 - DNA, 1152 bp, Arabidopsis thaliana
atgactgatccttattccaatttcttcacagactggttcaagtctaatccttttcaccattaccctaattcctccactaacccctctcctcatcctcttcctcctgttactcctccctcttccttcttcttcttccctcaatccggagacctccgccgtccaccgccgccaccaactcctcctccttctcctcctctccgagaagccctccctctcctcagcctcagccccgccaacaaacaacaagaccaccatcacaaccatgaccaccttattcaagaaccaccttcaacctccatggatgtcgactacgatcatcaccatcaagatgatcatcataacctcgatgacgatgaccatgacgtcaccgttgctcttcacataggccttccaagccctagtgctcaagagatggcctctttgctcatgatgtcttcttcttcctcttcctcgaggaccactcatcatcacgaggacatgaatcacaagaaagacctcgaccatgagtacagccacggagctgtcggaggaggagaagatgacgatgaagattcagtcggcggagacggcggctgtagaatcagcagactcaacaagggtcaatattggatccctacaccttctcagattctcattggccctactcagttctcatgtcctgtttgcttcaaaaccttcaacagatacaataacatgcagatgcatatgtggggacatggatcacaatacagaaaaggacctgaatctctaaggggaacacaaccaacaggaatgctaaggcttccgtgctattgctgcgccccaggctgtcgcaacaacattgaccatccaagggcaaagcctctcaaagacttcagaacccttcaaacacattacaagagaaaacatgggatcaaacctttcatgtgtaggaaatgtggaaaggctttcgcagtccgaggggactggagaacacatgagaagaattgtggcaaactttggtattgcatatgtggatctgatttcaagcacaagagatctctcaaagatcacatcaaggcttttgggaatggtcatggagcctacggaattgatgggtttgatgaagaagatgagcctgcctctgaggtagaacaattagacaatgatcatgagtcaatgcagtctaaatag

SEQ ID NO: 2792 - protein, 383 aa, Arabidopsis thaliana
MTDPYSNFFTDWFKSNPFHHYPNSSTNPSPHPLPPVTPPSSFFFFPQSGDLRRPPPPPTPPPSPPLREALPLLSLSPANKQQDHHHNHDHLIQEPPSTSMDVDYDHHHQDDHHNLDDDDHDVTVALHIGLPSPSAQEMASLLMMSSSSSSSRTTHHHEDMNHKKDLDHEYSHGAVGGGEDDDEDSVGGDGGCRISRLNKGQYWIPTPSQILIGPTQFSCPVCFKTFNRYNNMQMHMWGHGSQYRKGPESLRGTQPTGMLRLPCYCCAPGCRNNIDHPRAKPLKDFRTLQTHYKRKHGIKPFMCRKCGKAFAVRGDWRTHEKNCGKLWYCICGSDFKHKRSLKDHIKAFGNGHGAYGIDGFDEEDEPASEVEQLDNDHESMQSK

SEQ ID NO: 2793 - DNA, 1677 bp, Arabidopsis thaliana
aatgtcggttgtacaattatttgtcactaaagtttccaaatttcttctaaactgatgaatcaatggaacatgatgacgaaaaagataaatccacggtggcgggaactgacccacccatttccaccgcctctctattccccagatttttttcaattatctgactacagtttgtcggttacttccttccctaaacctttataaaccattaaacctctcatccttcttctcttaaaccccctaattatcacacacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcattattcattttgaatgcactctttatacatatatataatattgatgagtttgattgttccaaaaaaaaa

SEQ ID NO: 2794 - protein, 412 aa, Arabidopsis thaliana
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 2795 - DNA, 1838 bp, Arabidopsis thaliana
tccctcccagagtaagaacttccatactttgctctagatttcttgagaaaagatgcagccgatcttccatgcgatccttaaaaatgaccttccagcttttttagagttggtagaagatagtgaatcgtctctggaggagagaaacgaggaagaacacttgaacaacacggttttgcacatggctgcaaagtttggtcaccgagaactcgtctccaagattattgagctccgaccttccctcgtgtcttcccgcaacgcatacagaaacacacctttgcatcttgctgctatccttggagatgtaaacatagttatgcagatgttagagactggattggaagtgtgttctgcacgcaatatcaacaaccacacaccactccacttggcttgccgtagcaattccatagaggctgccagactcatcgcggaaaagacacaatcaattggcctcggtgaactcattctcgccatatcaagtggatccactagtatcgtagggactatactggagagattcccagacctagctagggaagaagcttgggtggttgaagacggctcacaatcaacgctactgcatcatgcgtgtgataagggagactttgaactgacaactatattgttagggctcgatcaaggattagaagaagcacttaaccccaatggtttatcacctctgcatcttgcggtcctcagaggctcggttgtgatcctggaggagttcttggacaaggttccattgtctttcagctcaatcacgccgtcgaaagagacagtctttcatctcgctgctcgaaacaaaaatatggatgcctttgtttttatggcagagagtttgggaattaacagccaaattcttctacagcaaaccgatgaaagtggcaacactgtcttacatattgctgcatccgtctcttttgatgctcctcttatacgttacattgttggtaagaatatagtagatatcacgtccaagaacaagatgggttttgaagcttttcaacttctccctcgagaagcccaagactttgagttgttatcaaggtggctgagatttggtaccgagacttcacaagagctggattctgagaacaatgtagaacaacacgaaggctctcaagaggtcgaggtaatacggttgctaaggattataggaataaacacatcagagatagcagagagaaagagaagcaaggaacaggaagtggaaagaggtcgtcagaacttggaatatcagatgcatatagaagcattacagaatgcaagaaatacgattgctatagtggcagtcttgattgcttcagttgcttatgccggtgggataaaccctccggggggcgtctaccaagacgggccatggagagggaaatccttagtggggaaaacaacggcgtttaaggtctttgcgatatgcaacaacatcgcactgttcacgtccttgggcatcgttattcttcttgttagcatcataccttacaagaggaaacccttaaagagattattggtggccacgcataggatgatgtgggtttctgtaggtttcatggcgacggcttatatagcggcgtcttgggtgaccataccgcattatcatggaacacaatggttatttccagcaattgtagccgttgctggtggagcgttgaccgtactctttttctatctcggagttgagaccatcggtcattggtttaagaagatgaatcgtgtaggggataatataccttcctttgcaagaaccagttcagatttagccgtctccggaaaatcaggctatttcacctattaagaaaaactggttttctaatttccctgtaacctgtgtaattgtgtatgtg

SEQ ID NO: 2796 - protein, 578 aa, Arabidopsis thaliana
MQPIFHAILKNDLPAFLELVEDSESSLEERNEEEHLNNTVLHMAAKFGHRELVSKIIELRPSLVSSRNAYRNTPLHLAAILGDVNIVMQMLETGLEVCSARNINNHTPLHLACRSNSIEAARLIAEKTQSIGLGELILAISSGSTSIVGTILERFPDLAREEAWVVEDGSQSTLLHHACDKGDFELTTILLGLDQGLEEALNPNGLSPLHLAVLRGSVVILEEFLDKVPLSFSSITPSKETVFHLAARNKNMDAFVFMAESLGINSQILLQQTDESGNTVLHIAASVSFDAPLIRYIVGKNIVDITSKNKMGFEAFQLLPREAQDFELLSRWLRFGTETSQELDSENNVEQHEGSQEVEVIRLLRIIGINTSEIAERKRSKEQEVERGRQNLEYQMHIEALQNARNTIAIVAVLIASVAYAGGINPPGGVYQDGPWRGKSLVGKTTAFKVFAICNNIALFTSLGIVILLVSIIPYKRKPLKRLLVATHRMMWVSVGFMATAYIAASWVTIPHYHGTQWLFPAIVAVAGGALTVLFFYLGVETIGHWFKKMNRVGDNIPSFARTSSDLAVSGKSGYFTY

SEQ ID NO: 2797 - DNA, 1307 bp, Arabidopsis thaliana
gccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctc

SEQ ID NO: 2798 - protein, 420 aa, Arabidopsis thaliana
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 2799 - DNA, 1153 bp, Arabidopsis thaliana
aaccacacaaaacaaaacaaaaaaacatattgatggggatgaagaaggtaaagctatctttgatagctaatgaaagatcaaggaaaacatccttcatgaagaggaaaaacgggatattcaagaaactccacgagttgtcaactctatgtggtgtccaagcttgtgctctcatctatagtccattcataccggttccagagtcatggccgtcaagggaaggtgctaaaaaggtagcttcaaagtttctggagatgccgcggacagcccgaaccaggaagatgatggatcaagaaacccatcttatggagaggattaccaaagcaaaagagcaactaaagaatttggctgctgagaaccgagaattacaggttagacgatttatgtttgattgtgttgaaggcaaaatgtcccagtatcgttatgatgcaaaagaccttcaagatttgctatcttgtatgaatctatatctcgatcagcttaacggaaggatcgagtccattaaagaaaacggtgagtcgttgttgtcttccgtctctccttttcctactagaattggtgttgacgaaattggtgatgagtcgttttccgactctcctattcattctacaactagggttgtagatactcctaatgctaccaatcctcatgttcttgcgggcgatatgactccttttcttgatgcggacgcaaatgcggtaactgctcccagtcgattttctgatcatattcaatatgaaaatatgaatatgagtcaaaatctgcatgaaccgtttcaacaccttgttcctactaacgtttgtgatttttatcaaaatcagaatatgaatcaggttcaataccaggctcctaataatctgtttaatcagattcaacgagaattctacaacataaatttgaatctgaatttgaatctgaattcaaatcagtatctgaatcaacaacaatcattcatgaatccgatggtggaacaacatatgaatcatgttggagggcgtgaaagcattcctttcgtggacagaaactactacaactacaatcaactaccagccgttgatcttgcttccaccagttacatgccttcaaccaccgatgtttatgatccttacatcaacaacaatctctaatcacaaaagacggagattttctagtttaa

SEQ ID NO: 2800 - protein, 363 aa, Arabidopsis thaliana
MGMKKVKLSLIANERSRKTSFMKRKNGIFKKLHELSTLCGVQACALIYSPFIPVPESWPSREGAKKVASKFLEMPRTARTRKMMDQETHLMERITKAKEQLKNLAAENRELQVRRFMFDCVEGKMSQYRYDAKDLQDLLSCMNLYLDQLNGRIESIKENGESLLSSVSPFPTRIGVDEIGDESFSDSPIHSTTRVVDTPNATNPHVLAGDMTPFLDADANAVTAPSRFSDHIQYENMNMSQNLHEPFQHLVPTNVCDFYQNQNMNQVQYQAPNNLFNQIQREFYNINLNLNLNLNSNQYLNQQQSFMNPMVEQHMNHVGGRESIPFVDRNYYNYNQLPAVDLASTSYMPSTTDVYDPYINNNL

SEQ ID NO: 2801 - DNA, 1026 bp, Arabidopsis thaliana
atggaaggaggaggaagaggaccaaatcaaacgattctcagtgaaatagaacatatgcctgaagctccacgtcaacgtatctctcatcaccgtcgagctcgctctgaaaccttcttctccggcgaatcaatcgacgatctcctcttattcgatccttccgatatcgatttctcttctctagacttcctcaacgctccaccaccaccacaacaatcacaacaacaaccgcaagcttctcccatgtccgttgattcggaagaaacctcatcgaacggtgttgttcctcctaattctcttcctccaaaacccgaagctagattcggtcgccatgttcgtagcttctcggttgattccgatttcttcgatgatttgggtgttactgaggagaagtttatagctacaagttcaggagagaagaagaaagggaatcatcatcatagcaggagtaattctatggatggagagatgagttcggcgtcgtttaatatcgaatcgattttagcttctgtgagtggtaaagatagtgggaagaagaatatgggtatgggtggtgatagacttgctgagcttgctttgcttgatcctaaaagagctaaaaggattttagcgaatagacaatctgcggcgaggtcgaaagagaggaagattaggtatactggtgagttagagaggaaggttcagacacttcagaatgaagctactacattgtctgctcaagtcactatgttacagagaggaacatcagagctgaacactgaaaataaacacctcaaaatgcggcttcaagctttagagcaacaagctgaacttagggatgctttgaatgaagcgctgcgggatgaactgaaccgacttaaggtggtagctggagaaattcctcaggggaatggaaattcttacaaccgtgctcaattctcatctcagcaatcggcaatgaatcagtttgggaacaaaacgaaccaacagatgagtacaaacgggcagccatcgctcccaagctacatggatttcaccaagagaggctga

SEQ ID NO: 2802 - protein, 341 aa, Arabidopsis thaliana
MEGGGRGPNQTILSEIEHMPEAPRQRISHHRRARSETFFSGESIDDLLLFDPSDIDFSSLDFLNAPPPPQQSQQQPQASPMSVDSEETSSNGVVPPNSLPPKPEARFGRHVRSFSVDSDFFDDLGVTEEKFIATSSGEKKKGNHHHSRSNSMDGEMSSASFNIESILASVSGKDSGKKNMGMGGDRLAELALLDPKRAKRILANRQSAARSKERKIRYTGELERKVQTLQNEATTLSAQVTMLQRGTSELNTENKHLKMRLQALEQQAELRDALNEALRDELNRLKVVAGEIPQGNGNSYNRAQFSSQQSAMNQFGNKTNQQMSTNGQPSLPSYMDFTKRG

SEQ ID NO: 2803 - DNA, 1099 bp, Arabidopsis thaliana
tcgacccacgcgtccgcccacgcgtccggatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacatcaaaatgctcatcgagcgcgtttgagaaggcttgagtacatatcagaccttgaaaggaccatccaagtgctacaagttgaaggatgtgaaatgtcatctgccattcactacttggatcagcagttactcatgcttagcatggaaaatagagctttaaaacaacgtatggatagtttagcagaaatccaaaagcttaaacatgtggagcagcaattgcttgagagagagataggaaacctacagtttcgacgacaccaacaacaaccacagcaaaaccaaaaacaagtccaagcaatacaaaatcgatacaccaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaacctaaaaaagcatcgttatgtaaatcaaaatgtggttgcccatatcctcctctattgcatttctctctatttatggcatggtagagaatctcttgtcaagaaacttcatgttatgtaataacttgtaatccttcttatttcatctattatatatatgaataagtaatttttttgccaaaaaaaaaaaaaaaaaaaaaaaa

SEQ ID NO: 2804 - protein, 212 aa, Arabidopsis thaliana
MPSKENHVAGSSWQFQNYDLWQSNSYEQHNKLGWDFSTANGTNIQRNMSCGALNMSSKPIEKHVSKMKEGTSTKPDGPRSKTDSKRIKHQNAHRARLRRLEYISDLERTIQVLQVEGCEMSSAIHYLDQQLLMLSMENRALKQRMDSLAEIQKLKHVEQQLLEREIGNLQFRRHQQQPQQNQKQVQAIQNRYTKYQPPVTQEPDAQFAALAI

SEQ ID NO: 2805 - DNA, 450 bp, Arabidopsis thaliana
atgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaa

SEQ ID NO: 2806 - protein, 149 aa, Arabidopsis thaliana
MLDPTEKVIDSESMESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 2807 - DNA, 722 bp, Arabidopsis thaliana
gagagagaaacattgatctctgaatattgtgaacatgttgaaatcaagtaacaagagaaaaagcaaagaagagaagaagttacaagaagggaagtaccttggagtgaggagacgtccatggggaagatatgcagctgaaatcagaaacccttttactaaagaaagacattggcttggaacgtttgatacagccgaagaagctgcttttgcatatgacgttgctgctcgatccatcagcggctctctagctacaacaaacttcttctacactgaaaacacctctttagaaagacatccacaacagtctttggagcctcatatgacttggggatcttctagtctctgtcttcttcaagatcagccttttgaaaacaaccattttgttgctgatcctatctcttcttctttttctcaaaaacaagagtcttctaccaatctcactaacactttctcacattgttataatgatggtgatcatgttggccaaagcaaagagatttctttacctaatgatatgtcaaacagtttattcggtcatcaggacaaagtcggtgaacatgacaatgcagaccatatgaagtttggctcagttctcagcgacgaacctctctgctttgagtatgactacattgggaattatcttcagagttttctcaaagatgtcaacgacgatgctccacagtttcttatgtgagcttgtattaccgatccttcaatttatg

SEQ ID NO: 2808 - protein, 219 aa, Arabidopsis thaliana
MLKSSNKRKSKEEKKLQEGKYLGVRRRPWGRYAAEIRNPFTKERHWLGTFDTAEEAAFAYDVAARSISGSLATTNFFYTENTSLERHPQQSLEPHMTWGSSSLCLLQDQPFENNHFVADPISSSFSQKQESSTNLTNTFSHCYNDGDHVGQSKEISLPNDMSNSLFGHQDKVGEHDNADHMKFGSVLSDEPLCFEYDYIGNYLQSFLKDVNDDAPQFLM

SEQ ID NO: 2809 - DNA, 640 bp, Arabidopsis thaliana
ataacaaactcatcaaacttcctcagcgtttctttttcttacataaacaatttttcttacataaacaaatcttgttgtttgttgttgtcatggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactgattaagatttaattatgattattagatataattaaatgtttctgaattgag

SEQ ID NO: 2810 - protein, 166 aa, Arabidopsis thaliana
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 2811 - DNA, 765 bp, Arabidopsis thaliana
aatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagt

SEQ ID NO: 2812 - protein, 230 aa, Arabidopsis thaliana
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 2813 - DNA, 1148 bp, Arabidopsis thaliana
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctg

SEQ ID NO: 2814 - protein, 337 aa, Arabidopsis thaliana
MEKSDPPPVPKPGATIIPSSDPIPNADPIPSSSFHRRSRSDDMSMFMFMDPLSSAAPPSSDDLPSDDDLFSSFIDVDSLTSNPNPFQNPSLSSNSVSGAANPPPPPSSRPRHRHSNSVDAGCAMYAGDIMDAKKAMPPEKLSELWNIDPKRAKRILANRQSAARSKERKARYIQELERKVQSLQTEATTLSAQLTLYQRDTNGLANENTELKLRLQAMEQQAQLRNALNEALRKEVERMKMETGEISGNSDSFDMGMQQIQYSSSTFMAIPPYHGSMNLHDMQMHSSFNPMEMSNSQSVSDFLQNGRMQGLEISSNSSSLVKSEGPSLSASESSSAY

SEQ ID NO: 2815 - DNA, 1120 bp, Arabidopsis thaliana
gaacagcaaaaccctagatttcctgttcaagctcaagaccgtacaaaactttggaactcatatataaagatctcgagaatagcattatgaatatcgtctcttggaaagatgcaaacgacgaagttgcaggcggcgctacgacaagacgtgaaagagaagtaaaagaggatcaagaagaaaccgaagtcagagccaccagtggcaaaaccgtaattaaaaagcagcctacatcgatctcttcttcttcttcttcgtggatgaaatccaaggatccgaggattgttagggtttcacgcgcctttggaggcaaagaccgtcacagcaaagtgtgtacgttacgtggactacgtgacagacgcgtgagattatcagtcccaacggctattcagctctacgatcttcaagaacggctcggtgttgaccagcctagcaaagccgttgactggttgcttgatgcagctaaagaggagatcgacgagctacctccgttacctatctcgccggaaaatttcagcatcttcaaccatcatcagtccttcttgaatcttggtcaacggcccggtcaagatccgacccaactcgggtttaaaatcaatggatgtgtacaaaagtctactactactagccgcgaagaaaacgatagagagaaaggagaaaacgatgtcgtttacacaaacaatcatcatgttgggtcttatggaacttatcacaacctggaacatcatcatcatcatcaccaacatttgagtttacaggcagattatcatagtcatcaactacatagtcttgtcccatttccatcacaaattttggtatgtccaatgacgacatcaccaacaactacaactatacaatctttgtttccatcatcatcgtcagctggttcagggactatggagacattagatccgaggcaaatgtagcaacaatggtggtagagacattgataatcggatgtcgtcggtccaattcaaccgaactaatagcactacaacggctaacatgtcgaggcatctaggctcggagcgttgtacaagtagaggaagtgatcaccatatgtgaagttagattattgaaacgatataattgttgtttgatgtgttcagaaataaggggacac

SEQ ID NO: 2816 - protein, 278 aa, Arabidopsis thaliana
MNIVSWKDANDEVAGGATTRREREVKEDQEETEVRATSGKTVIKKQPTSISSSSSSWMKSKDPRIVRVSRAFGGKDRHSKVCTLRGLRDRRVRLSVPTAIQLYDLQERLGVDQPSKAVDWLLDAAKEEIDELPPLPISPENFSIFNHHQSFLNLGQRPGQDPTQLGFKINGCVQKSTTTSREENDREKGENDVVYTNNHHVGSYGTYHNLEHHHHHHQHLSLQADYHSHQLHSLVPFPSQILVCPMTTSPTTTTIQSLFPSSSSAGSGTMETLDPRQM

SEQ ID NO: 2817 - DNA, 1064 bp, Arabidopsis thaliana
attctgttacttagtaccggagtttagtcggagagagaacaatgatcagtttcagagaagagaacatcgatctcaacttgattaaaacaattagtgtaatctgtaatgatccagacgccaccgattcctctagcgacgatgaatctatctccggcaataatcctcgccgtcagatcaaaccaaaaccaccgaaacgttacgtctcaaagatctgtgtcccgacgctgatcaaaaggtatgagaacgtttcgaattctacagggaataaagcagccggaaaccggaaaacgtcgtcgggtttcaaaggcgtacgacggaggccgtgggggaaatttgcggcggagataagaaatccgtttgagaagaagagaaagtggcttggaacgtttcctactgaagaagaagcagcagaagcttaccaaaagagtaaaagagagtttgatgaacgattgggtttagttaaacaggaaaaagacctagtagatttgaccaagccgtgcggtgtacgtaaaccagaagagaaggaagttactgagaagtcgaattgcaaaaaggtaaataagagaattgttactgatcagaagccatttggttgtggttataacgctgatcatgaagaagagggagtgattagtaaaatgttggaagatccgttgatgacatcgtcaattgctgatatttttggtgattcggctgttgaagcaaatgatatttgggtggattacaattcagtggaatttatttccattgtagatgatttcaagtttgattttgtggagaatgatagagtaggaaaggagaaaacatttggatttaagattggggatcacactaaagttaatcaacatgccaaaatcgtatcgaccaatggggacttattcgtcgatgatttacttgattttgatccgttgatagatgattttaagttagaagattttcctatggatgatcttggattattaggagatccagaggatgatgattttagttggtttaatggtactactgattggatcgataagtttttatgaatactttcttgacacggccaacggtattagtac

SEQ ID NO: 2818 - protein, 329 aa, Arabidopsis thaliana
MISFREENIDLNLIKTISVICNDPDATDSSSDDESISGNNPRRQIKPKPPKRYVSKICVPTLIKRYENVSNSTGNKAAGNRKTSSGFKGVRRRPWGKFAAEIRNPFEKKRKWLGTFPTEEEAAEAYQKSKREFDERLGLVKQEKDLVDLTKPCGVRKPEEKEVTEKSNCKKVNKRIVTDQKPFGCGYNADHEEEGVISKMLEDPLMTSSIADIFGDSAVEANDIWVDYNSVEFISIVDDFKFDFVENDRVGKEKTFGFKIGDHTKVNQHAKIVSTNGDLFVDDLLDFDPLIDDFKLEDFPMDDLGLLGDPEDDDFSWFNGTTDWIDKFL

SEQ ID NO: 2819 - DNA, 904 bp, Arabidopsis thaliana
gagcaaaaactttgtgtgcgtgtgtgtgtgtgttcatggctggtcttaggaattccggtaacagcgacaaagcgcaaaacgatggcaaaggtgtaccatctgcctacagaggagtccggaagagaaaatgggggaaatgggtgtctgaaatccgtgaaccggggaccaagaaccgtatctggctaggcagtttcgagactcctgaaatggctgcaaccgcatacgacgtggcagcatttcatttcagagggagagaagctcgtctcaacttccctgagctcgccagcagccttccacgtcctgcagactctagctcagacagcattcgcatggcagttcatgaggcaacactctgccgcaccaccgaaggaacagagtcagccatgcaagtggacagctcaagctcctccaatgtagctccaacaatggtcagactctcgcccagggaaattcaagcgatcaacgagtcaactttgggatctcctactacaatgatgcattcaacatacgaccctatggagtttgctaatgatgtggagatgaatgcttgggaaacataccagagtgactttctttgggacccttaaccccaaaacctaactcatggagagcttctacagctcaatcttacaataccagcataagttactggcttagaatacttaaatttattgaagtttagttttcagagtctaccacaagggttgttgattctgacgttatagcaaagaataaagctcatcagattttggagggaaagactctatgagcttgatgggtccctgaaaggacctcttcacaaatatttttaaatttttttgttactagtagaaacatagattatgaggtgtgacttattattattttttacaattgtttgttacctcattgatgtatttgattt

SEQ ID NO: 2820 - protein, 183 aa, Arabidopsis thaliana
MAGLRNSGNSDKAQNDGKGVPSAYRGVRKRKWGKWVSEIREPGTKNRIWLGSFETPEMAATAYDVAAFHFRGREARLNFPELASSLPRPADSSSDSIRMAVHEATLCRTTEGTESAMQVDSSSSSNVAPTMVRLSPREIQAINESTLGSPTTMMHSTYDPMEFANDVEMNAWETYQSDFLWDP

SEQ ID NO: 2821 - DNA, 739 bp, Arabidopsis thaliana
acaaaaatctcttgttcttcttgtcttcaatatggaggatggggaagcttcaacaatcactttcttaccaaccacggaaccaaaacccctacaaaaccctaacttgctggccaaaccaaaaaaagagactaaacaaaaaaaacctaaaaccaccaaaggtcgacagaagatagagatcaaggagatcatgctggagacccgaaggcaagtgacgttttccaaacgacgatccgggcttttcaaaaaagcggcagaattaagcgttctctgcggcgcacagattggtatcataacgttttcacgttgcgataggatctactcgtttggtaacgtgaactcactcatcgataaatacttgcgtaaggctccggtgatgctgaggtcacatcccggtggtaacgtggcaaacggagaggaagataacgacggtttgatgtggtgggagagagcggtggagagtgtgccggaggagcatatggaagagtacaagaatgccttgagtgtgttaagggagaatttgttgacgaggatctaccagatgagtggtgatcggacggttgagaatcttccggcatttccaaatgagatggctatggctgactggaaattaacgaatgaaaatctgatggctaggaacgatcgaggttatggaggtaacaatggtgatttggagtttgcgtttatgcctcaaaacggtagacagtgaggtgttttttctttaatttattattacagtttg

SEQ ID NO: 2822 - protein, 224 aa, Arabidopsis thaliana
MEDGEASTITFLPTTEPKPLQNPNLLAKPKKETKQKKPKTTKGRQKIEIKEIMLETRRQVTFSKRRSGLFKKAAELSVLCGAQIGIITFSRCDRIYSFGNVNSLIDKYLRKAPVMLRSHPGGNVANGEEDNDGLMWWERAVESVPEEHMEEYKNALSVLRENLLTRIYQMSGDRTVENLPAFPNEMAMADWKLTNENLMARNDRGYGGNNGDLEFAFMPQNGRQ

SEQ ID NO: 2823 - DNA, 1225 bp, Arabidopsis thaliana
gggatttgactttagcacttcaaaatccaaagctaaaagacaaaaaagaatagaggttcgatttgcatctccattaatgggcatcgatctttctcttaagctcgaggccgaggagaaaaagaaagagatagaaggatcgaaacatagccgtgagaacaaagaagacgaagaacatgatgctagtggtgatgaagatgaacaaatggtgaaagaagacgaagatgattcttcttctttaggtttaagaacccgagaagaagaaaacgaacgtgaagagctcttgcagctacagatccagatggaaagtgtgaaagaagagaatactaggttgaggaagcttgtcgagcagactcttgaagattatcgtcatcttgagatgaaattcccggttatcgataaaaccaagaagatggatcttgaaatgttccttggagtacaaggcaaacgatgtgtggatataacaagtaaggctcggaaaagaggagctgagagatctccgtcaatggaaagagaaatagggctttcactttctctagagaaaaaacagaaacaagaagagagcaaagaagctgttcagtctcatcaccaaagatacaatagtagcagcttagatatgaatatgccacgtatcatttcatcttctcaaggtaatagaaaggccagggtgtccgtgagggcgagatgtgagaccgcaacaatgaatgatggatgccaatggaggaagtacggtcagaaaaccgcgaaagggaatccatgtcctcgagcttattaccgatgcaccgtggctccaggatgtcccgttagaaaacaggtgcaaaggtgtttagaagacatgtcaatactgataacaacctacgaaggaacacataaccatccacttccggtcggagcaacagccatggcttccactgcctctacttctccattcttgttactcgattccagtgacaacctctctcatccttcctattaccaaactcctcaagccatagactcttctttgattacatacccacaaaatagcagctacaacaatcgaaccataagaagcttgaactttgatggtccatctagaggagatcacgtttcatcttctcaaaaccgattaaattggatgatgtagagtttcctatatctctatgcttgttctttggtcccattatttgtcattatggattctttgcctttcttcttgttctcgtttctaacatttatgtttcgtata

SEQ ID NO: 2824 - protein, 348 aa, Arabidopsis thaliana
MGIDLSLKLEAEEKKKEIEGSKHSRENKEDEEHDASGDEDEQMVKEDEDDSSSLGLRTREEENEREELLQLQIQMESVKEENTRLRKLVEQTLEDYRHLEMKFPVIDKTKKMDLEMFLGVQGKRCVDITSKARKRGAERSPSMEREIGLSLSLEKKQKQEESKEAVQSHHQRYNSSSLDMNMPRIISSSQGNRKARVSVRARCETATMNDGCQWRKYGQKTAKGNPCPRAYYRCTVAPGCPVRKQVQRCLEDMSILITTYEGTHNHPLPVGATAMASTASTSPFLLLDSSDNLSHPSYYQTPQAIDSSLITYPQNSSYNNRTIRSLNFDGPSRGDHVSSSQNRLNWMM

SEQ ID NO: 2825 - DNA, 828 bp, Arabidopsis thaliana
cctacaagaaatcaaacactagttctggtttctgcaaacatgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatgatcatacatattcatacttgatgatttaaatttctttgtatttgaactgctgattttaatactgcatgtatccatttgacgaagctcaatcgtctcgagtatatctctattatctaacagtattgagaaaaaaggagtttcagtaaaaaaaaaaaaaaaaaaaaaa

SEQ ID NO: 2826 - protein, 207 aa, Arabidopsis thaliana
MSSTKQAKGRKTKGKQKIEMKKVENYGDRMITFSKRKTGIFKKMNELVAMCDVEVAFLIFSQPKKPYTFAHPSMKKVADRLKNPSRQEPLERDDTRPLVEAYKKRRLHDLVKKMEALEEELAMDLEKLKLLKESRNEKKLDKMWWNFPSEGLSAKELQQRYQAMLELRDNLCDNMAHLRLGKDCGGSSSVRVGRRVSGGVRLFDREA

SEQ ID NO: 2827 - DNA, 777 bp, Arabidopsis thaliana
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 2828 - protein, 258 aa, Arabidopsis thaliana
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 2829 - DNA, 1366 bp, Arabidopsis thaliana
ctgtgattgtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccatatatatagttcttgaaagattgttgtatcatgattgtaaaaactgttttgagtatggaaaaagacttgcagataaaa

SEQ ID NO: 2830 - protein, 366 aa, Arabidopsis thaliana
MSNYGVKELTWENGQLTVHGLGDEVEPTTSNNPIWTQSLNGCETLESVVHQAALQQPSKFQLQSPNGPNHNYESKDGSCSRKRGYPQEMDRWFAVQEESHRVGHSVTASASGTNMSWASFESGRSLKTARTGDRDYFRSGSETQDTEGDEQETRGEAGRSNGRRGRAAAIHNESERRRRDRINQRMRTLQKLLPTASKADKVSILDDVIEHLKQLQAQVQFMSLRANLPQQMMIPQLPPPQSVLSIQHQQQQQQQQQQQQQQQQQFQMSLLATMARMGMGGGGNGYGGLVPPPPPPPMMVPPMGNRDCTNGSSATLSDPYSAFFAQTMNMDLYNKMAAAIYRQQSDQTTKVNIGMPSSSSNHEKRD

SEQ ID NO: 2831 - DNA, 929 bp, Arabidopsis thaliana
gtctctaatataagcttgaacgttgctatatataaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctaggaaacgaagagaaaggataaacgataggctaaagacattgcagagcctagttcctaatgggacaaaggtcgatataagcacaatgctggaagatgctgtccattacgtgaagttcctgcagcttcaaatcaagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagcattttaataaaaaaaaaaaa

SEQ ID NO: 2832 - protein, 223 aa, Arabidopsis thaliana
MENEAFVDGELESLLGMFNFDQCSSNESSFCNAPNETDVFSSDDFFPFGTILQSNYAAVLDGSNHQTNRNVDSRQDLLKPRKKQKLSSESNLVTEPKTAWRDGQSLSSYNSSDDEKALGLVSNTSKSLKRKAKANRGIASDPQSLYARKRRERINDRLKTLQSLVPNGTKVDISTMLEDAVHYVKFLQLQIKLLSSEDLWMYAPLAHNGLNMGLHHNLLSRLI

SEQ ID NO: 2833 - DNA, 1496 bp, Arabidopsis thaliana
ttttttttttagggttcataagaacaaattggattttgagctcacagtataaataacccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgcatggacggaagagaagcaatggcatttccaggctcgcattctcagtactatcttcaaagaggagcctttactaatctcgcaccttcccaagtcgcgagtgggcttcacgcgccgccgccacatacgggattgaggccaatgtctaaccctaacattcatcaccctcaggctaacaatccaggacctcctttctcggattttggacacaccattcacatgggagtggtctcctctgcttctgatgctgatgtgcaaccgccaccgccaccgccaccaccagaggaaccgatggttaagaggaaacgtggacggccaagaaagtatggagaaccgatggttagtaataagtctagggactcttctccaatgtctgatcctaatgaacctaaacgggccagaggtcgacctcctggaactggaaggaagcaacgcttggctaatcttggtgagtggatgaatacttcagctggacttgcttttgcacctcatgtgatcagcattggagcaggagaagacattgctgcgaaagttttgtcattttcacaacaaagacctcgggctctttgtataatgtcaggcactggaaccatttcttcagtcactctgtgcaaacccggttcaaccgatcgtcacttaacatacgagggaccttttgagattataagttttggtggatcttatttggtgaatgaagaaggtggatccagaagtcgaacaggcggattgagtgtctctctttctcgtcccgatggtagtattattgccggtggagttgacatgcttatcgcagccaaccttgttcaggtggtggcatgtagttttgtatacggagcaagggcaaagactcataataacaataacaagaccatcagacaagaaaaggaaccaaatgaagaggacaacaatagtgaaatggagaccacaccgggtagtgcagctgaaccagcagcatctgcgggtcagcagacgccacagaacttctcttctcagggaataagggggtggcccggttcaggctcaggctctggcagatcacttgacatttgcagaaacccactcactgattttgatttgactcgtggatgatatacactattagtctttgaagcagcagcatacaaaatgtgattgctgtacatatgttattgtagatttctctctgggaatgttgaaatcagacatttaaggattgatactagatctctcagctccttctaacattgttaatgtaacagaaccctcccactttcatgctatttgc

SEQ ID NO: 2834 - protein, 361 aa, Arabidopsis thaliana
MDGREAMAFPGSHSQYYLQRGAFTNLAPSQVASGLHAPPPHTGLRPMSNPNIHHPQANNPGPPFSDFGHTIHMGVVSSASDADVQPPPPPPPPEEPMVKRKRGRPRKYGEPMVSNKSRDSSPMSDPNEPKRARGRPPGTGRKQRLANLGEWMNTSAGLAFAPHVISIGAGEDIAAKVLSFSQQRPRALCIMSGTGTISSVTLCKPGSTDRHLTYEGPFEIISFGGSYLVNEEGGSRSRTGGLSVSLSRPDGSIIAGGVDMLIAANLVQVVACSFVYGARAKTHNNNNKTIRQEKEPNEEDNNSEMETTPGSAAEPAASAGQQTPQNFSSQGIRGWPGSGSGSGRSLDICRNPLTDFDLTRG

SEQ ID NO: 2835 - DNA, 1666 bp, Arabidopsis thaliana
gcaaaaagaaaaaatgaaaaaaaatccctaactctctctctctagaaattcttatttttgtgcgtatctctctaaaaaggaatggatcctaacgaaagccaccatcaccaccaacaacaacagctccatcacctccaccaacagcaacagcaacagcagcagcagcaacgactcacttctccttacttccaccaccaactacagcaccatcaccaccttccaaccaccgtagcaaccaccgcttctaccggaaacgccgttccatcttccaacaatgggcttttccctccgcagcctcagccacagcaccagcctaatgatgggtcatcttctctcgcggtgtaccctcattcagttccgtcctcggctgtgacggcgccgatggagccggtaaagaggaagaggggtcgaccaagaaagtatgtgacgccggaacaagccctagcggctaagaaattggcgtcttctgcgagtagttcgtctgctaaacagaggcgagagcttgctgctgttaccggtggtacggtatcgactaattccgggtcatccaagaaatctcagcttggttctgtcgggaaaactggacaatgttttactccgcatattgttaatatagctcctggcgaggatgtggtccagaaaattatgatgttcgcaaaccaaagcaagcatgaactatgcgttctttctgcatcaggcactatctctaatgcatccttgcgccaaccggctccatcaggaggcaacttaccatatgagggtcaatacgagattctctcactatctggatcctatatccgaactgaacaaggtggtaaatccggcggccttagcgtttctttatctgcttcagatggtcagatcatcggtggagcgattggtagccatctcacagctgctggcccggttcaggtgattcttggtacgtttcagcttgatagaaagaaggatgccgccgggagtggtgggaaaggggatgcttcaaacagtggaagtcggttaacttctcctgtaagctctggacagttgcttggcatgggtttccctcctggtatggaatctacgggaagaaatccaatgaggggaaacgacgagcaacatgatcatcatcatcatcaagccggtttgggtggacctcatcatttcatgatgcaagcgccgcaggggatacacatgacacattccaggccatctgaatggcgcggaggaggcaacagcggtcatgatggcagaggcggtggcgggtatgatttgtcaggaaggataggacatgagtcgtcggagaatggagattacgagcagcaaataccggattagcagagcttccaggagaagtgtgtagagtttagatcccaagtagagaaacagaaggcgagcaaagaatctgaactgagagaggacttattagacagagactcgtctgaagggtctttaatcatagaaagaagttgctgagtgattgcttttgttcttcttcttggtacggtgtattatattaactccacaaccttttttttatactttcagtaacgattctccttcactttcaatttcattccttttttttatactctttttcttttcttataatattttttttggtttttctttcgtttgttactaaaaaaggaaatgctctttttgtgaaatatatacacttcgtttg

SEQ ID NO: 2836 - protein, 411 aa, Arabidopsis thaliana
MDPNESHHHHQQQQLHHLHQQQQQQQQQQRLTSPYFHHQLQHHHHLPTTVATTASTGNAVPSSNNGLFPPQPQPQHQPNDGSSSLAVYPHSVPSSAVTAPMEPVKRKRGRPRKYVTPEQALAAKKLASSASSSSAKQRRELAAVTGGTVSTNSGSSKKSQLGSVGKTGQCFTPHIVNIAPGEDVVQKIMMFANQSKHELCVLSASGTISNASLRQPAPSGGNLPYEGQYEILSLSGSYIRTEQGGKSGGLSVSLSASDGQIIGGAIGSHLTAAGPVQVILGTFQLDRKKDAAGSGGKGDASNSGSRLTSPVSSGQLLGMGFPPGMESTGRNPMRGNDEQHDHHHHQAGLGGPHHFMMQAPQGIHMTHSRPSEWRGGGNSGHDGRGGGGYDLSGRIGHESSENGDYEQQIPD

SEQ ID NO: 2837 - DNA, 1440 bp, Arabidopsis thaliana
atggctcctgtctcgttacctccaggtttccgattccatccaacagacgaggaactaattacttactatctaaaaagaaagatcaacggtctagaaatcgaacttgaagttatcgctgaagttgatctttacaagtgtgagccatgggacttaccagggaagtccttgcttccgagcaaagaccaagaatggtacttcttcagcccacgagaccggaagtatcccaacggctcaaggacaaaccgggcaactaaaggcggttattggaaggctacaggtaaagaccgccgagttagttggagagaccgagccataggaaccaagaagacattggtttactaccgtgggcgcgcgccacatggcataagaactggttgggtcatgcacgaatatcgacttgatgaaacagaatgtgagccttctgcatacggcatgcaggacgcatatgcactttgtcgtgtgttcaaaaagattgttattgaagctaagccaagagatcaacatcggtcatatgtccacgcgatgtcgaatgtgagtggtaattgctcatcgagttttgacacttgttcggatctcgaaatcagttcaactactcatcaagttcaaaacacattccaaccgcgatttggcaacgagcgatttaactccaacgcaatcagcaacgaggattggtcacaatactacggttcttcttatagaccgttccctactccatataaggttaacacagagatcgaatgttcaatgttacaacacaatatatatctaccaccgttgcgtgtagagaactctgcgtttagtgattccgatttcttcacgagtatgactcacaacaacgaccatggcgttttcgatgactttacttttgctgcaagtaactccaaccacaataatagcgttggtgatcaagtgatccacgttggcaattatgatgaacaattaataacatctaaccgtcatatgaaccagactggttatataaaagagcagaagatcagatcgagtttggataatactgacgaagatccaggatttcatggtaacaataccaatgacaacatagatatcgatgattttctctcgtttgatatatataacgaggacaacgtgaatcaaatagaagataatgaagacgtgaatacaaatgaaacccttgattcatcgggattcgaggtggttgaagaagaaactagatttaacaaccaaatgctcatctcgacatatcaaacgacaaagattctatatcaccaagtcgtaccttgtcacacgttgaaagttcacgtcaatcctattagtcacaatgtggaagagagaacattgttcattgaagaggacaaagattcttggttacaaagagctgagaagatcacgaagacaaaactaacactttttagtttaatggctcagcaatactacaaatgtcttgctatttttttctga

SEQ ID NO: 2838 - protein, 479 aa, Arabidopsis thaliana
MAPVSLPPGFRFHPTDEELITYYLKRKINGLEIELEVIAEVDLYKCEPWDLPGKSLLPSKDQEWYFFSPRDRKYPNGSRTNRATKGGYWKATGKDRRVSWRDRAIGTKKTLVYYRGRAPHGIRTGWVMHEYRLDETECEPSAYGMQDAYALCRVFKKIVIEAKPRDQHRSYVHAMSNVSGNCSSSFDTCSDLEISSTTHQVQNTFQPRFGNERFNSNAISNEDWSQYYGSSYRPFPTPYKVNTEIECSMLQHNIYLPPLRVENSAFSDSDFFTSMTHNNDHGVFDDFTFAASNSNHNNSVGDQVIHVGNYDEQLITSNRHMNQTGYIKEQKIRSSLDNTDEDPGFHGNNTNDNIDIDDFLSFDIYNEDNVNQIEDNEDVNTNETLDSSGFEVVEEETRFNNQMLISTYQTTKILYHQVVPCHTLKVHVNPISHNVEERTLFIEEDKDSWLQRAEKITKTKLTLFSLMAQQYYKCLAIFF

SEQ ID NO: 2839 - DNA, 1005 bp, Arabidopsis thaliana
atgatgcttgcggtggaagatgtgttaagcgaactcgccggagaagaaaggaacgagagaggattgccacctggcttccggtttcacccgacggacgaagagctcattaccttctacttagcttccaaaatcttccatggtggtctctccggcattcacatttccgaagttgatctcaaccgctgtgaaccttgggagctaccagaaatggcgaagatgggagagagagagtggtacttttatagtctaagggacaggaaatatccgacaggtttgaggactaacagagcaactactgctggatactggaaagctaccggcaaagataaggaagtcttctccggcggaggaggacagcttgttgggatgaagaagacgttggtgttctacaaaggtagggctccacgtggcctcaagactaagtgggtcatgcatgagtatcgcctcgaaaacgaccattcacaccgccacacgtgtaaggaggaatgggtgatttgcagagtgttcaataaaacaggagacagaaaaaatgttggattaatccataaccaaatcagctaccttcataaccattcactctcaacaacacatcatcatcatcatgaagccttacctttgcttatagaaccttccaacaaaaccctaaccaacttcccatcactactctacgatgatccacaccaaaactacaataataacaacttccttcatggatcatcaggccacaacatcgacgagctcaaagccttaatcaaccctgtcgtctctcagctcaacggtatcatctttccttcagggaacaacaacaacgacgaagacgacttcgactttaacctcggcgtgaaaacagagcagtcttcgaacggtaacgaaattgacgtacgagattacttggagaaccctctgtttcaggaagcgagttatggtctgttgggtttttcgtcttctcctggacctcttcacatgctactagattctccatgtcctttaggattccagctgtag

SEQ ID NO: 2840 - protein, 334 aa, Arabidopsis thaliana
MMLAVEDVLSELAGEERNERGLPPGFRFHPTDEELITFYLASKIFHGGLSGIHISEVDLNRCEPWELPEMAKMGEREWYFYSLRDRKYPTGLRTNRATTAGYWKATGKDKEVFSGGGGQLVGMKKTLVFYKGRAPRGLKTKWVMHEYRLENDHSHRHTCKEEWVICRVFNKTGDRKNVGLIHNQISYLHNHSLSTTHHHHHEALPLLIEPSNKTLTNFPSLLYDDPHQNYNNNNFLHGSSGHNIDELKALINPVVSQLNGIIFPSGNNNNDEDDFDFNLGVKTEQSSNGNEIDVRDYLENPLFQEASYGLLGFSSSPGPLHMLLDSPCPLGFQL

SEQ ID NO: 2841 - DNA, 1312 bp, Arabidopsis thaliana
ttctttctttctttctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgctaactcattatatatagaagatattgcagaccagaatatgcgcagggagggtataacaatatggcgttgtaacaatggatctatatattacctcattgttgatcaatagcacaccaccggtacgtttgcaatttcttcatgtatatttcttgttatatatgtagttatatatccaggtataattttgatgtaacacaacattaatcttaatcgtggatccatcccacatttgatgcatgtatgtgcacttaagaaaaagaacatggaggaaataacgttattttttattattct

SEQ ID NO: 2842 - protein, 287 aa, Arabidopsis thaliana
MNDPDNPDLSNDDSAWRELTLTAQDSDFFDRDTSNILSDFGWNLHHSSDHPHSLRFDSDLTQTTGVKPTTVTSSCSSSAAVSVAVTSTNNNPSATSSSSEDPAENSTASAEKTPPPETPVKEKKKAQKRIRQPRFAFMTKSDVDNLEDGYRWRKYGQKAVKNSPFPRSYYRCTNSRCTVKKRVERSSDDPSIVITTYEGQHCHQTIGFPRGGILTAHDPHSFTSHHHLPPPLPNPYYYQELLHQLHRDNNAPSPRLPRPTTEDTPAVSTPSEEGLLGDIVPQTMRNP

SEQ ID NO: 2843 - DNA, 827 bp, Arabidopsis thaliana
gctttctcacctttataaaatagaaaatggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtgataaagcactcgtagttaagtagttgtagtt

SEQ ID NO: 2844 - protein, 256 aa, Arabidopsis thaliana
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 2845 - DNA, 687 bp, Arabidopsis thaliana
tcctcccttaattagtatcaaaaatggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttg

SEQ ID NO: 2846 - protein, 211 aa, Arabidopsis thaliana
MVKTLQKTPKRMSSPSSSSSSSSSTSSSSIRMKKYKGVRMRSWGSWVSEIRAPNQKTRIWLGSYSTAEAAARAYDAALLCLKGSSANNLNFPEISTSLYHIINNGDNNNDMSPKSIQRVAAAAAAANTDPSSSSVSTSSPLLSSPSEDLYDVVSMSQYDQQVSLSESSSWYNCFDGDDQFMFINGVSAPYLTTSLSDDFFEEGDIRLWNFC

SEQ ID NO: 2847 - DNA, 1067 bp, Arabidopsis thaliana
gccaaaattttaccaacatttttctcttctcatatcaaagtttctctctcatttcttcatcacacttcactgccctgttttttttcctcattttgaatagttctcaaacttatatatttttccccctgaagcctagctatttctttttatttgcattaatctcgggatccgaatcgaaaaaagcaatcagaataatagacttgtacgatacttgtgcctaagctaacacaatggcagaggaatactacagcctccgctcggagagagtaactcagcttcttgtccctaactcggagtctgactcagtgagtgacaaaagcaaagctgagcaaagcgagaagaagactaaacgtgggagagactccggtaaacaccctgtttatcgcggagtaaggatgaggaactggggaaaatgggtgtcggagattcgtgagccgaggaagaaatcacgtatttggctgggaactttcccgacgccggagatggcggcgcgtgcacacgacgtggcggctctgagcattaaaggaacggccgctatactaaacttccctgaactcgctgactcattccctcgacccgtttcattaagccctcgagacattcagacagcagctcttaaagcagctcacatggaaccgacgacgtcgttttcatcttccacgtcttcgtcgtcgtctttgtcttctacgtcttcgctcgagtctcttgtgttggtgatggacctctcgaggactgagtcggaggagctcggtgagattgtggagcttccaagtctcggggcgagttacgacgtcgactcggctaaccttgggaacgagtttgtcttctatgactcagttgactactgtttatatccgccgccgtggggacagtcgtccgaagataactatggtcacggaattagccctaattttggccatggcttgtcatgggatctctaacagtttattttgtatcattaccataatgttttgtttaaaacagtttattttgtatcattgccataatgttttgtttaatcacgtttttaaaaccctttgctgtttttgttttttttttgagttttt

SEQ ID NO: 2848 - protein, 236 aa, Arabidopsis thaliana
MAEEYYSLRSERVTQLLVPNSESDSVSDKSKAEQSEKKTKRGRDSGKHPVYRGVRMRNWGKWVSEIREPRKKSRIWLGTFPTPEMAARAHDVAALSIKGTAAILNFPELADSFPRPVSLSPRDIQTAALKAAHMEPTTSFSSSTSSSSSLSSTSSLESLVLVMDLSRTESEELGEIVELPSLGASYDVDSANLGNEFVFYDSVDYCLYPPPWGQSSEDNYGHGISPNFGHGLSWDL

SEQ ID NO: 2849 - DNA, 755 bp, Arabidopsis thaliana
cgtcgacacaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaagc

SEQ ID NO: 2850 - protein, 206 aa, Arabidopsis thaliana
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 2851 - DNA, 573 bp, Arabidopsis thaliana
atgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttga

SEQ ID NO: 2852 - protein, 190 aa, Arabidopsis thaliana
MTSSIHELSDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 2853 - DNA, 1263 bp, Arabidopsis thaliana
gcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgg

SEQ ID NO: 2854 - protein, 383 aa, Arabidopsis thaliana
MEDDDEIQSIPSPGDSSLSPQAPPSPPILPTNDVTVAVVKKPQPGLSSQSPSMNALALVVHTPSVTGGGGSGNRNGRGGGGGSGGGGGGRDDCWSEEATKVLIEAWGDRFSEPGKGTLKQQHWKEVAEIVNKSRQCKYPKTDIQCKNRIDTVKKKYKQEKAKIASGDGPSKWVFFKKLESLIGGTTTFIASSKASEKAPMGGALGNSRSSMFKRQTKGNQIVQQQQEKRGSDSMRWHFRKRSASETESESDPEPEASPEESAESLPPLQPIQPLSFHMPKRLKVDKSGGGGSGVGDVARAILGFTEAYEKAETAKLKLMAELEKERMKFAKEMELQRMQFLKTQLEITQNNQEEEERSRQRGERRIVDDDDDRNGKNNGNVSS

SEQ ID NO: 2855 - DNA, 1414 bp, Arabidopsis thaliana
cacgagcttctgactcagatccggcgatatcgaattccatggaggacgatgaagacatccgatctcagggttccgattcacctgatccgtcttcctccccgccggcgggacgaatcacggttacggtggcttcggcaggtccgccttcttattctctgactcctccgggtaattcgtcgcagaaggatccggatgcgttggctctggcgctgcttccgattcaggccagcggtggagggaataacagcagtgggagaccaaccggcggcggcgggagggaggattgttggagcgaagcagctacggctgtgttgattgatgcgtggggtgagagatacttggagcttagcagagggaatctgaagcagaagcactggaaagaggtggctgagattgtgagcagcagagaggattacggtaaaattcccaaaactgatatacagtgtaagaataggatcgatacggtgaagaagaagtataaacaagagaaggtgagaatcgctaacggcggtggccgtagcagatgggtgttcttcgacaagcttgaccgtctgattggatcaacggcgaagatcccgacggcaacttctggagtcagcggtcctgtcggaggattgcataagattcctatgggtattccaatgggaagtcgttcgaatctgtaccatcagcaagctaaggctgcaacaccgcctttcaataatcttgaccggttaattggagctacggctagagtctcagctgcttctttcggtggcagtggtggaggaggcggaggaggatctgtcaatgtacctatgggaattccgatgagtagccgttcagctccgtttggacagcaagggaggactctgccacagcaaggtaggacactgccacagcaacagcagcaagggatgatggtgaaaaggtgtagtgagtcgaaacgctggcgtttcaggaagaggaacgcttctgattcagactcggaatctgaagcagcaatgtcagatgattccggtgacagtttaccacctcctcctctgtcgaagaggatgaagacggaggagaagaagaagcaagatggtgatggagtggggaacaaatggagggagctgactcgggcaatcatgagattcggtgaagcttatgagcaaacagagaatgcgaaactgcaacaggtggttgagatggagaaagagaggatgaagttcttgaaggagcttgagttgcagagaatgcagttctttgtgaagactcaattggagatatcacaacttaagcagcaacatgggaggagaatgggaaacaccagtaatgatcatcatcacagccgcaagaacaacatcaatgcgattgtcaacaacaacaacgatttgggtaataactagaatttagtgatgcagtgtcgtaattgatatattttagatttgag

SEQ ID NO: 2856 - protein, 443 aa, Arabidopsis thaliana
MEDDEDIRSQGSDSPDPSSSPPAGRITVTVASAGPPSYSLTPPGNSSQKDPDALALALLPIQASGGGNNSSGRPTGGGGREDCWSEAATAVLIDAWGERYLELSRGNLKQKHWKEVAEIVSSREDYGKIPKTDIQCKNRIDTVKKKYKQEKVRIANGGGRSRWVFFDKLDRLIGSTAKIPTATSGVSGPVGGLHKIPMGIPMGSRSNLYHQQAKAATPPFNNLDRLIGATARVSAASFGGSGGGGGGGSVNVPMGIPMSSRSAPFGQQGRTLPQQGRTLPQQQQQGMMVKRCSESKRWRFRKRNASDSDSESEAAMSDDSGDSLPPPPLSKRMKTEEKKKQDGDGVGNKWRELTRAIMRFGEAYEQTENAKLQQVVEMEKERMKFLKELELQRMQFFVKTQLEISQLKQQHGRRMGNTSNDHHHSRKNNINAIVNNNNDLGNN

SEQ ID NO: 2857 - DNA, 1001 bp, Arabidopsis thaliana
tggcgacgccttcgccgacctcctctcctccctctgattcaaaccctaattctgccgctactccgccgcatcagaaacaaccaccctctcctcctcaacccacgaatccatcctctccaccaccgcacaccaccgtcgtagctttagccgcatcaacctccgccgtcgccagaaaaacccaacctgttctctggactcaagacgagaccctcctcttaatcgaatcatacaaagagaaatggttcgcaattggtcgtggtcctctaaaatcaactcactgggaagagatcgccgttgctgcctcatctcgttccggcgttgaacggacatctacacagtgtaggcataagatcgagaagatgcgtaaaagattccgatctgagagacagagtatgggacctatctcaatttggcctttctataatcaaatggaggaattggattcttcaaatcctgctccgatctcagctcgtcctctcactcgtcttcctcctaattcgaataatcgctacgtagacgacgaagaagaagatgaagaagaggataacaataactacgaagaagaggaagaagaagatgagagacagagcaaatcgaggagtattaattacatattgagaagacctggaactgttaacagatttgctggagttggtggaggattgttgtcatggggacaaaaagagagatcatcgaagaggaagaggaacgatggagacggtggtgagaggcggaggaaaggaatgcgagccgttgcagcggagattagggcgtttgctgagagagtaatggtaatggagaagaagaagattgagtttgctaaagagactgtgagacttcgtaaggaaatggagattcgtagaatcaatttgattcagagttctcaaactcagcttcttcaatttatcaacaatgcttttgattctttctaacgtagagatttagtcattgttgcttttagatttgtaacataggtaacggatttgaagaaatgcactatg

SEQ ID NO: 2858 - protein, 190 aa, Arabidopsis thaliana
MRKRFRSERQSMGPISIWPFYNQMEELDSSNPAPISARPLTRLPPNSNNRYVDDEEEDEEEDNNNYEEEEEEDERQSKSRSINYILRRPGTVNRFAGVGGGLLSWGQKERSSKRKRNDGDGGERRRKGMRAVAAEIRAFAERVMVMEKKKIEFAKETVRLRKEMEIRRINLIQSSQTQLLQFINNAFDSF

SEQ ID NO: 2859 - DNA, 1050 bp, Arabidopsis thaliana
gacctctttgatcccttcattccccatcaaacaaccatgtttccttctttcattactcacattcaaagccctaattctcaccatcactactcttcgccttcttttcctttctcttccgattttcttgagagttttgatgaatccttcttgataaaccaattcttgttacagcagcaagatgtagcagcaaatgttgttgaatctccttggaaattttgcaagaagcttgagcttaagaagaagaatgagaagtgtgttgatggaagcacctcacaagaggttcaatggagaaggacggtcaaaaaaagggacaggcatagtaagatctgcacggctcaaggtcctagagaccggaggatgaggctgtctcttcagattgctcgcaagtttttcgatcttcaagacatgttgggtttcgacaaggcgagcaagacgattgaatggcttttctccaaatcaaagacttccatcaaacaacttaaagaaagagtggctgcatcggaaggaggaggaaaggatgaacatctccaggttgatgaaaaggaaaaggatgagacactgaagttgagagtctcaaagagaagaacaaagactatggagagctcttttaagactaaagagtcgagagagagagctagaaagcgagcaagagagagaacaatggcaaagatgaagatgagattatttgagacctcggaaacaatttcagatcctcatcaagaaactagagagatcaagataaccaatggtgtacaattactagaaaaggaaaataaagaacaagaatggagtaatactaatgatgttcacatggtagagtatcaaatggattctgtgagcatcatagagaagtttcttggactaaccagtgactctagctcctcttccatttttggtgactccgaggaatgttacacaagtcttagttcagtaagaggtacaatttcagcagcaggtaacagcaatgtgttaactaaaaaccctaattgagtaatgcagttttgattaatattagctttttggtaattccaggaatgtcgacaccaaggg

SEQ ID NO: 2860 - protein, 317 aa, Arabidopsis thaliana
MFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 2861 - DNA, 1409 bp, Arabidopsis thaliana
cataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcaggc

SEQ ID NO: 2862 - protein, 397 aa, Arabidopsis thaliana
MIPNDDDDANSMKNYPLNDDDANSMKNYPLNDDDANSMENYPLRSIPTELSHTCSLIPPSLPNPSEAAADMSFNSELNQIMARPCDMLPANGGAVGHNPFLEPGFNCPETTDWIPSPLPHIYFPSGSPNLIMEDGVIDEIHKQSDLPLWYDDLITTDEDPLMSSILGDLLLDTNFNSASKVQQPSMQSQIQQPQAVLQQPSSCVELRPLDRTVSSNSNNNSNSNNAAAAAKGRMRWTPELHEVFVDAVNQLGGSNEATPKGVLKHMKVEGLTIFHVKSHLQKYRTAKYIPVPSEGSPEARLTPLEQITSDDTKRGIDITETLRIQMEHQKKLHEQLESLRTMQLRIEEQGKALLMMIEKQNMGFGGPEQGEKTSAKTPENGSEESESPRPKRPRNEE

SEQ ID NO: 2863 - DNA, 1038 bp, Arabidopsis thaliana
atgggcagatcgccatgttgtgataaggccgggttgaagaaagggccttggactccagaagaggatcagaaacttttggcttatattgaagaacatggccatggaagctggcgttctttgcctgagaaagccggtctccaaaggtgtggaaagagttgcagactcagatggactaactacctaagacctgacatcaagagaggcaaattcactgtacaagaagaacaaaccatcattcaactccacgctctcctcggaaacaggtggtcagcgattgcaactcatttaccaaagaggacagacaacgagatcaagaactactggaacacacacttgaagaaacgtctgatcaaaatggggatagatccagtgactcacaagcacaaaaacgagactctttcgtcttccacaggacaatcaaagaacgcagccacgcttagtcatatggctcaatgggagagtgcaagactcgacgctgaagcaaggctagctagagaatcaaagcttctccatttacagcattaccaaaacaataacaaccttaacaaatcagcagctcctcaacaacattgcttcactcaaaaaacatcaacaaactggactaaaccaaaccaaggaaacggagaccaacagcttgaatctccgacatcgacggtgacattctctgagaatcttctgatgcctttaggaatccctacggatagcagcagaaatagaaacaataacaacaatgagtcctcggcgatgattgaattggccgtatcttcgtcaacctcctccgatgtgagtctggtcaaagaacatgaacacgactggattaggcagatcaactgtggtagtggaggaataggagaaggattcacgagtctattgatcggtgattcggtcggccggggtttacccaccgggaaaaacgaagcgacggcgggcgtggggaatgagagtgagtataactactatgaggataacaagaattactggaatagcattctcaacttggttgattcttcaccgtccgattccgcgacgatgttctga

SEQ ID NO: 2864 - protein, 345 aa, Arabidopsis thaliana
MGRSPCCDKAGLKKGPWTPEEDQKLLAYIEEHGHGSWRSLPEKAGLQRCGKSCRLRWTNYLRPDIKRGKFTVQEEQTIIQLHALLGNRWSAIATHLPKRTDNEIKNYWNTHLKKRLIKMGIDPVTHKHKNETLSSSTGQSKNAATLSHMAQWESARLDAEARLARESKLLHLQHYQNNNNLNKSAAPQQHCFTQKTSTNWTKPNQGNGDQQLESPTSTVTFSENLLMPLGIPTDSSRNRNNNNNESSAMIELAVSSSTSSDVSLVKEHEHDWIRQINCGSGGIGEGFTSLLIGDSVGRGLPTGKNEATAGVGNESEYNYYEDNKNYWNSILNLVDSSPSDSATMF

SEQ ID NO: 2865 - DNA, 1106 bp, Arabidopsis thaliana
ccctttcgtttttatttaaatttcttgggtcgtttcttaaatttgtatgtgtttattaatggagatcaacaataatgccaacaatactaatactactattgataatcacaaggcaaagatgagccttgtgttgtcaacggatgctaagccaaggttgaaatggacttgtgatcttcatcacaaattcatcgaagccgttaatcaacttggaggacctaacaaagcaacacctaagggtttgatgaaggttatggagattcctgggcttaccttataccatctcaagagccatttacagaaatatcggttagggaagagcatgaagttcgatgataacaagctagaagtttcctctgcatcagagaatcaagaagttgagagtaaaaacgattcaagagatctccgaggctgcagtgtcaccgaagaaaacagcaatccagctaaagaagggctacaaatcacagaggctttacaaatgcagatggaagttcagaagaaacttcatgaacaaatcgaagttcagaggcatttgcaggtgaagattgaggcacaaggaaagtatctacagtccgttttaatgaaagctcaacaaactctcgctggctactcatcttcaaatctcggcatggattttgcgaggaccgagctctctagattagcttcaatggtgaacagaggctgtccaagcacttcgttctcagagctaacgcaagtagaagaagaagaagaaggtttcttgtggtacaagaaaccagaaaacagaggaattagtcagctgagatgttcagtagagagctcgttgacatcttcagagacctcagagacaaaactggatactgacaataaccttaataaatcgattgaacttccgttgatggagatcaactcggaagtgatgaaggggaagaagagaagcataaacgacgtcgtttgcgtggagcagcctctaatgaagagagcttttggagttgatgatgatgagcatttgaagttgagtttgaatacttacaagaaagacatggaggcgtgtacgaacataggactagggtttaattaaaaaaaaaacattttactaaagttatataaaaatgttttaaaagaatcca

SEQ ID NO: 2866 - protein, 336 aa, Arabidopsis thaliana
MCLLMEINNNANNTNTTIDNHKAKMSLVLSTDAKPRLKWTCDLHHKFIEAVNQLGGPNKATPKGLMKVMEIPGLTLYHLKSHLQKYRLGKSMKFDDNKLEVSSASENQEVESKNDSRDLRGCSVTEENSNPAKEGLQITEALQMQMEVQKKLHEQIEVQRHLQVKIEAQGKYLQSVLMKAQQTLAGYSSSNLGMDFARTELSRLASMVNRGCPSTSFSELTQVEEEEEGFLWYKKPENRGISQLRCSVESSLTSSETSETKLDTDNNLNKSIELPLMEINSEVMKGKKRSINDVVCVEQPLMKRAFGVDDDEHLKLSLNTYKKDMEACTNIGLGFN

SEQ ID NO: 2867 - DNA, 1002 bp, Arabidopsis thaliana
tcgaccaatttagaccattccaaattcgtcgtccttttctctgtgtagtctaattatatattacaagtagatgaattggttacctgaagctgaagctgaggagcacttgaaaggtattctctctggtgatttctttgatggtctcaccaatcaccttgattgcccacttgaagacatcgattccaccaatggtgagggagattgggtcgccaggtttcaagaccttgagcctcctcccttggatatgttccctgctttgccttctgacctcacctcttgtcccaagggcgccgctcgtgtgcggattcccaacaacatgattcctgctttgaagcagtcctgttcttctgaagccttgtccggcattaatagcactccccaccaatcttcagctcctcctgatatcaaagtttcatatctatttcagtctctaactccagtgtcagttctcgagaacagttatggttctctctccacccaaaactccggatctcagagattggctttccctgtgaaaggcatgagaagcaagcgcagacgccccacaacagtgagacttagctaccttttcccctttgaacccagaaagtcaactccgggtgaatcagtaaccgagggttactattcttctgagcaacatgccaagaagaagcgcaagattcatctgatcacccacaccgagtcttccactttggagtcaagtaagtcggatgggatagtccggatatgcactcattgtgagacaatcacgaccccacagtggaggcaaggacccagtggacccaagaccctctgcaacgcttgcggagtccggttcaaatctggtcgcctagttccagaataccggccagcctcaagcccgaccttcatcccatctgtgcattcaaactcacacaggaagatcattgagatgagaaagaaggacgacgagtttgataccagcatgattcgcagtgatatccagaaggtaaagcaggggaggaagaaaatggtataaaagta

SEQ ID NO: 2868 - protein, 308 aa, Arabidopsis thaliana
MNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 2869 - DNA, 804 bp, Arabidopsis thaliana
atgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaa

SEQ ID NO: 2870 - protein, 267 aa, Arabidopsis thaliana
MSSSTMYRGVNMFSPANTNWIFQEVREATWTAEENKRFEKALAYLDDKDNLESWSKIADLIPGKTVADVIKRYKELEDDVSDIEAGLIPIPGYGGDASSAANSDYFFGLENSSYGYDYVVGGKRSSPAMTDCFRSPMPEKERKKGVPWTEDEHLRFLMGLKKYGKGDWRNIAKSFVTTRTPTQVASHAQKYFLRQLTDGKDKRRSSIHDITTVNIPDADASATATTADVALSPTPANSFDVFLQPNPHYSFASASASSYYNAFPQWS

SEQ ID NO: 2871 - DNA, 1223 bp, Arabidopsis thaliana
caatattctttctccattgagattaagcttctttctcgctgtcgtctctctatagatcttggttcttagtcccttttgaataataatgatggtggagatggattacgctaagaaaatgcagaaatgtcatgaatacgttgaagcacttgaagaagaacagaagaaaatccaagtctttcaacgcgagcttcctttatgtttagagcttgtcactcaagcgatcgaagcttgtcggaaggagttatctggtacgacgacaactacatcagaacagtgttcagaacagaccacaagtgtttgtggtggtcctgtctttgaagagtttattcctatcaagaaaattagttccttgtgtgaagaagtacaagaagaagaagaagaagatggtgaacatgaatcttctccagaacttgtgaataataagaaatcagattggcttagatctgttcagctatggaatcattcaccggatctaaatccaaaagaggagcgtgtagctaagaaagcgaaagtggtggaggtgaaaccaaaaagcggtgcgtttcagccgtttcaaaagcgcgttttggagactgatttgcaaccggcggtgaaagtagctagttcgatgccagcgacgacgacgagttctacgacggaaacttgtggtggtaaaagtgatttgattaaagctggagatgaggaaagacggatagagcagcagcaatcgcagtcgcatacgcatagaaaacaaaggcggtgctggtcgccggaattacaccgtcgattcctaaacgcgcttcagcagcttggaggatctcatgttgctacaccaaagcaaatcagggatcacatgaaggttgatggattaacaaacgacgaagttaaaagccatttacagaaatatagacttcacacaagaaggccagcagcaacatccgtggcggcacaaagtaccgggaatcagcaacaaccacaatttgtggtggttggaggcatatgggtaccatcgtcacaagattttccaccaccgtccgatgtagccaacaagggtggtgtatatgctccggttgcggtggcgcaatctccaaaacgttcgttggagagaagttgcaactcgccggcggcatcttcctctacaaatacaaatacttctactcctgtgtcataatctgatagtcatactataatcatctcctgatgttgattttggtgtaggtttgaaaatgtttatgtgaatgtaa

SEQ ID NO: 2872 - protein, 354 aa, Arabidopsis thaliana
MMVEMDYAKKMQKCHEYVEALEEEQKKIQVFQRELPLCLELVTQAIEACRKELSGTTTTTSEQCSEQTTSVCGGPVFEEFIPIKKISSLCEEVQEEEEEDGEHESSPELVNNKKSDWLRSVQLWNHSPDLNPKEERVAKKAKVVEVKPKSGAFQPFQKRVLETDLQPAVKVASSMPATTTSSTTETCGGKSDLIKAGDEERRIEQQQSQSHTHRKQRRCWSPELHRRFLNALQQLGGSHVATPKQIRDHMKVDGLTNDEVKSHLQKYRLHTRRPAATSVAAQSTGNQQQPQFVVVGGIWVPSSQDFPPPSDVANKGGVYAPVAVAQSPKRSLERSCNSPAASSSTNTNTSTPVS

SEQ ID NO: 2873 - DNA, 867 bp, Arabidopsis thaliana
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagtattgctacttattctaaaaaaaaaaaaaaaaaaaaaaaaa

SEQ ID NO: 2874 - protein, 192 aa, Arabidopsis thaliana
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 2875 - DNA, 832 bp, Arabidopsis thaliana
aacttagtgccacttagacacaataagaaaaccgttaacaagaagaaaaaaaaaagatcgaaaatggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttgataatctctgcttctacaatttttatgtaatttga

SEQ ID NO: 2876 - protein, 244 aa, Arabidopsis thaliana
MEYQTNFLSGEFSPENSSSSSWSSQESFLWEESFLHQSFDQSFLLSSPTDNYCDDFFAFESSIIKEEGKEATVAAEEEEKSYRGVRKRPWGKFAAEIRDSTRKGIRVWLGTFDTAEAAALAYDQAAFALKGSLAVLNFPADVVEESLRKMENVNLNDGESPVIALKRKHSMRNRPRGKKKSSSSSTLTSSPSSSSSYSSSSSSSSLSSRSRKQSVVMTQESNTTLVVLEDLGAEYLEELMRSCS

SEQ ID NO: 2877 - DNA, 908 bp, Arabidopsis thaliana
caaagtgaaaacataagatcatcttcttcgttgatagatcaatataggaactccagaagagaatcttgatcaattaagtatcatgtctcacatcgctgttgaaaggaatcgaagaaggcaaatgaacgagcatcttaaatcccttcgttctttgactccttgtttctacatcaaaaggggagatcaagcttcgatcatcggaggagtgatagagttcatcaaagagttgcagcaattggttcaagttcttgagtccaagaaacgtcgaaagaccctaaaccgaccatctttcccttatgatcaccagacaatcgagccatccagtttaggagccgccactacccgagtaccgtttagtcgaatcgaaaatgtgatgaccacaagtactttcaaggaagtaggagcatgctgtaactcccctcatgctaacgtagaagcaaagatttcaggttctaatgttgtattgagagttgtctctaggcgaatcgtggggcagctcgtaaagatcatctctgtcttagagaagctatcttttcaagttcttcacctcaatattagtagcatggaggagactgtcttatactttttcgttgttaagataggattggagtgtcacttaagcttggaggagctaactcttgaagttcagaaaagctttgtgtctgatgaagtgatcgtctctaccaattaaaaacaaaattctacatgtactagagcgtgtatcgttttttgggattaataatcatataatcgttacatgagccttgatactttgctagaaataagctcctctaaacaaaaccttctttttaaaaaaacacacttatgttttacttagtttgttgttgtatccgaagttgatcaacgttgtaatttcccacaataaatcatgacattttatatgctct

SEQ ID NO: 2878 - protein, 202 aa, Arabidopsis thaliana
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 2879 - DNA, 992 bp, Arabidopsis thaliana
attctccacaatttcataactttcttccgctcaacttcagataaattcggattctgtagctctttcaatacgactgcggagatcagagccaattatttggttatggcgtctctgatctcagatattgaaccgccgacgagtactacttcagatctcgttcggagaaagaagagatcctctgcttcatccgccgcatcgtctcgttcaagcgcatcttccgtctccggtgagattcacgcgcgatggcgatcggagaagcaacaacggatctactcagccaaactgttccaagcgctccaacaagtccgcctcaactcttccgcctcaacatcatcatctccaacggctcagaaacgaggaaaggccgtccgtgaagccgccgatcgagctcttgccgtttccgctcggggaagaacactctggagcagagcgatcttagctaatcggatcaaactgaaatttcgtaaacagagacgtcctcgagctacgatggcgattccggccatgactacggtggttagtagcagcagcaacagatcgagaaaacggagagtgtcggtgttgagattgaataagaagagtataccggatgttaaccggaaagtacgtgttctaggccggttagttcccggttgcggtaaacaatccgtaccggtgattctagaagaagcaactgattatattcaggctctggagatgcaagtgagagccatgaactctttagttcagcttctctcctcctacggctcagctcctccaccgatttgatgaggttaaaatcgtctttttaattctaccatctctcgatctttcacagcttatgtgtatatagaagattcggtttgattataatctgtaactactcttcccaaccgctgattcttctctgctacaagtaaaagtaaattttgaaccgagtcttcccatttttacgatcctcaagtctaaattaagtatatgattgattaataaagtctttaccattagggttc

SEQ ID NO: 2880 - protein, 221 aa, Arabidopsis thaliana
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATMAIPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 2881 - DNA, 1080 bp, Arabidopsis thaliana
atgataagcaaggatccaatatcgagtttacctccagggtttcgatttcatccaacagatgaagaactcattctccattacctaaggaagaaagtttcctcttccccagtcccgctttcgattatcgccgatgtcgatatctacaaatccgatccatgggatttaccagctaaggctccatttggggagaaagagtggtattttttcagtccgagggataggaaatatccaaacggagcaagaccaaacagagcagctgcgtctggatattggaaagcaaccggaacagataaattgattgcggtaccaaatggtgaagggtttcatgaaaacattggtataaaaaaagctcttgtgttttatagaggaaagcctccaaaaggtgttaaaaccaattggatcatgcatgaatatcgtcttgccgattcattatctcccaaaagaattaactcttctaggagcggtggtagcgaagttaataataattttggagataggaattctaaagaatattcgatgagactggatgattgggttctttgccggatttacaagaaatcacacgcttcattgtcatcacctgatgttgctttggtcacaagcaatcaagagcatgaggaaaatgacaacgaaccattcgtagaccgcggaacctttttgccaaatttgcaaaatgatcaaccccttaaacgccagaagtcttcttgttcgttctcaaacttactagacgctacagatttgacgtttctcgcaaattttctaaacgaaaccccggaaaatcgttctgaatcagatttttctttcatgattggcaatttctctaatcctgacatttacggaaaccattacttggatcagaagttaccgcagttgagctctcccacttcagagacaagcggcatcggaagcaaaagagagagagtggattttgcggaagaaacgataaacgcttcgaagaagatgatgaacacatatagttacaataatagtatagatcaaatggatcatagtatgatgcaacaacctagtttcctgaaccaggaactcatgatgagttctcaccttcaatatcaaggctag

SEQ ID NO: 2882 - protein, 359 aa, Arabidopsis thaliana
MISKDPISSLPPGFRFHPTDEELILHYLRKKVSSSPVPLSIIADVDIYKSDPWDLPAKAPFGEKEWYFFSPRDRKYPNGARPNRAAASGYWKATGTDKLIAVPNGEGFHENIGIKKALVFYRGKPPKGVKTNWIMHEYRLADSLSPKRINSSRSGGSEVNNNFGDRNSKEYSMRLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 2883 - DNA, 975 bp, Arabidopsis thaliana
atggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaa

SEQ ID NO: 2884 - protein, 324 aa, Arabidopsis thaliana
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 2885 - DNA, 2169 bp, Arabidopsis thaliana
atgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttga

SEQ ID NO: 2886 - protein, 722 aa, Arabidopsis thaliana
MSFVVGVGGSGSGSGGDGGGSHHHDGSETDRKKKRYHRHTAQQIQRLESSFKECPHPDEKQRNQLSRELGLAPRQIKFWFQNRRTQLKAQHERADNSALKAENDKIRCENIAIREALKHAICPNCGGPPVSEDPYFDEQKLRIENAHLREELERMSTIASKYMGRPISQLSTLHPMHISPLDLSMTSLTGCGPFGHGPSLDFDLLPGSSMAVGPNNNLQSQPNLAISDMDKPIMTGIALTAMEELLRLLQTNEPLWTRTDGCRDILNLGSYENVFPRSSNRGKNQNFRVEASRSSGIVFMNAMALVDMFMDCVKWTELFPSIIAASKTLAVISSGMGGTHEGALHLLYEEMEVLSPLVATREFCELRYCQQTEQGSWIVVNVSYDLPQFVSHSQSYRFPSGCLIQDMPNGYSKVTWVEHIETEEKELVHELYREIIHRGIAFGADRWVTTLQRMCERFASLSVPASSSRDLGGVILSPEGKRSMMRLAQRMISNYCLSVSRSNNTRSTVVSELNEVGIRVTAHKSPEPNGTVLCAATTFWLPNSPQNVFNFLKDERTRPQWDVLSNGNAVQEVAHISNGSHPGNCISVLRGSNATHSNNMLILQESSTDSSGAFVVYSPVDLAALNIAMSGEDPSYIPLLSSGFTISPDGNGSNSEQGGASTSSGRASASGSLITVGFQIMVSNLPTAKLNMESVETVNNLIGTTVHQIKTALSGPTASTTA

SEQ ID NO: 2887 - DNA, 1182 bp, Arabidopsis thaliana
cacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagtgatgatgtaaccgagattgttgattctctattgaataaacaccatgttatatagtaatttagcgacaaattgtatggttaaatgaagtaatatttatgttttgtttataaaa

SEQ ID NO: 2888 - protein, 318 aa, Arabidopsis thaliana
MEGRVNALSNINDLELHNFLVDPNFDQFINLIRGDHQTIDENPVLDFDLGPLQNSPCFIDENQFIPTPVDDLFDELPDLDSNVAESFRSFDGDSVRAGGEEDEEDYNDGDDSSATTTNNDGTRKTKTDRSRTLISERRRRGRMKDKLYALRSLVPNITKMDKASIVGDAVLYVQELQSQAKKLKSDIAGLEASLNSTGGYQEHAPDAQKTQPFRGINPPASKKIIQMDVIQVEEKGFYVRLVCNKGEGVAPSLYKSLESLTSFQVQNSNLSSPSPDTYLLTYTLDGTCFEQSLNLPNLKLWITGSLLNQGFEFIKSFT

SEQ ID NO: 2889 - DNA, 1012 bp, Arabidopsis thaliana
ccagatttaatttgagactctcaaagaaacaccatggaagaagagcaacctccggccaagaaacgaaacatggggagatctagaaaaggttgcatgaaaggtaaaggcggtccagagaacgccacgtgtactttccgtggagttaggcaacggacttggggtaaatgggtggctgagatccgtgagcctaaccgtgggactcgtctctggctcggcacgtttaatacctcggtcgaggccgccatggcttacgatgaagccgctaagaaactctatggacacgaggctaaactcaacttggtgcacccacaacaacaacaacaagtagtagtgaacagaaacttgtctttttctggccacgggtcgggttcttgggcttataataagaagctcgatatggttcatgggttggaccttggtctcggccaggcaagttgttcacgaggttcttgctcagagagatcgagttttctacaagaagatgatgatcatagtcataatcgatgttcgtcttcaagtggttcgaatctttgttggttattacctaaacaaagtgattcacaagatcaagagaccgttaatgctacgactagttatggcggtgaaggcggtggtggctctacgttaacgttttcgaccaatttgaaaccaaagaatttgatgagtcagaattatggattatacaatggagcttggtctaggtttcttgtggggcaagaaaagaagacggaacatgacgtgtcatcgtcgtgtggatcgtcggacaacaaggagagtatgttggttcctagttgcggcggagagaggatgcataggccggagttggaagagcgaacaggatatttggaaatggatgatcttttggagattgatgatttaggtttgttgattggcaaaaatggagatttcaagaattggtgttgtgaagagtttcaacatccatggaattggttctgagagtttttatttattactattatttatcatacatatttcttatatttgacttagg

SEQ ID NO: 2890 - protein, 307 aa, Arabidopsis thaliana
MEEEQPPAKKRNMGRSRKGCMKGKGGPENATCTFRGVRQRTWGKWVAEIREPNRGTRLWLGTFNTSVEAAMAYDEAAKKLYGHEAKLNLVHPQQQQQVVVNRNLSFSGHGSGSWAYNKKLDMVHGLDLGLGQASCSRGSCSERSSFLQEDDDHSHNRCSSSSGSNLCWLLPKQSDSQDQETVNATTSYGGEGGGGSTLTFSTNLKPKNLMSQNYGLYNGAWSRFLVGQEKKTEHDVSSSCGSSDNKESMLVPSCGGERMHRPELEERTGYLEMDDLLEIDDLGLLIGKNGDFKNWCCEEFQHPWNWF

SEQ ID NO: 2891 - DNA, 1379 bp, Arabidopsis thaliana
aaagaaaagaaaaataaagataatgaggacgaagactaagttagtactcatacctgatagacactttcggagagccacattcaggaagaggaatgcagggataaggaagaaactccacgagctgacaactctctgtgacatcaaagcatgtgcggtaatctacagtccgttcgagaatccaacggtgtggccgtcaaccgaaggtgttcaagaggtgatttcggagttcatggagaagccggcgacagaacggtccaagacgatgatgagtcatgagactttcttgcgggaccaaatcaccaaagaacaaaacaaactagagagtctacgtcgtgaaaaccgagaaactcagcttaagcattttatgtttgattgcgttggaggcaagatgagtgagcaacagtatggtgcaagggaccttcaagatttaagtctttttactgatcaatatcttaatcagcttaatgccaggaagaagttccttacagaatatggtgagtcttcttcttctgttcctcctctgtttgatgttgcgggtgccaatcctcctgttgttgcagatcaagctgcggtaactgttcctcctttgtttgctgttgcgggtgccaatcttcctgttgttgctgatcaagctgcggtaactgttcctcctctgtttgctgttgcgggtgccaatcttcctgttgttgcagatcaagctgcggttaatgttcctactggatttcataacatgaatgtgaaccagaatcagtatgagccggttcagccctatgtccctactggttttagtgatcatattcaatatcagaatatgaacttcaatcaaaaccaacaagagccggttcattaccaggctcttgctgttgcgggtgccggtcttcctatgactcagaatcagtatgagcccgttcactaccagagtcttgctgtcgcgggtggcggtcttcctatgagtcagttgcagtatgagccggttcagccttatatccctactgtttttagtgataatgttcaatatcagcatatgaatttgtatcaaaatcaacaagagccggttcactaccaagctcttggtgttgcaggtgccggtcttcctatgaatcagaatcagtatgagccggttcagccctatgtccctactggttttagtgatcattttcagtttgagaatatgaatttgaatcaaaatcaacaggagccggttcaataccaagctcctgttgattttaatcatcagattcaacaaggaaactatgatatgaatttgaaccagaatatgagtttggatccaaatcagtatccgtttcaaaatgatccattcatgaatatgttgacagaatatccttatgaataagcgggttatgttggagagcatgcac

SEQ ID NO: 2892 - protein, 443 aa, Arabidopsis thaliana
MRTKTKLVLIPDRHFRRATFRKRNAGIRKKLHELTTLCDIKACAVIYSPFENPTVWPSTEGVQEVISEFMEKPATERSKTMMSHETFLRDQITKEQNKLESLRRENRETQLKHFMFDCVGGKMSEQQYGARDLQDLSLFTDQYLNQLNARKKFLTEYGESSSSVPPLFDVAGANPPVVADQAAVTVPPLFAVAGANLPVVADQAAVTVPPLFAVAGANLPVVADQAAVNVPTGFHNMNVNQNQYEPVQPYVPTGFSDHIQYQNMNFNQNQQEPVHYQALAVAGAGLPMTQNQYEPVHYQSLAVAGGGLPMSQLQYEPVQPYIPTVFSDNVQYQHMNLYQNQQEPVHYQALGVAGAGLPMNQNQYEPVQPYVPTGFSDHFQFENMNLNQNQQEPVQYQAPVDFNHQIQQGNYDMNLNQNMSLDPNQYPFQNDPFMNMLTEYPYE

SEQ ID NO: 2893 - DNA, 1194 bp, Arabidopsis thaliana
ctctgtctctcgtatctttctactactctgtttcttgaattctaatgaacaacatcgacgacgcaaagacggagacttcagtgtcttcaggttcaagcgactctttcttgcctctcaagaaacgcatgagacttgatgacgaaccagaaaacgccctagtggtttcgtcttcaccaaagacggttgtggcttctggcaatgtcaagtacaaaggagtcgttcagcaacagaacggtcattggggtgcccagatttacgcagaccacaaaaggatttggcttggaactttcaaatccgctgatgaagccgccacggcttacgatagtgcatctatcaaactccgaagctttgacgctaactcgcaccggaacttcccttggtctacaatcactctcaacgaaccagactttcaaaattgctacacaacagagactgtgttgaacatgatcagagacggttcgtaccaacacaaattcagagattttctcagaatcagatctcagattgttgcgagtatcaacatcgggggaccaaaacaagcccgaggagaagtgaatcaagaatcagacaagtgtttttcttgcacacagctttttcagaaggaattgacaccgagcgatgtagggaaactaaataggcttgtgatacctaaaaagtatgcagtgaagtatatgcctttcataagcgctgatcaaagcgagaaagaagagggtgaaatagtaggatctgtggaagatgtggaggttgtgttttacgacagagcaatgagacaatggaagtttaggtattgttactggaaaagtagccagagctttgtcttcaccagaggatggaatagtttcgtgaaggagaagaatctcaaggagaaggatgttattgccttctacacttgcgatgtcccgaacaatgtgaagacattagaaggtcaaagaaagaacttcttgatgatcgatgttcattgcttttcagacaacggttccgtggtagctgaggaagtaagtatgacggttcatgacagttcagtgcaagtaaagaaaacagaaaacttggttagctccatgttagaagataaagaaaccaaatcagaggagaacaaaggagggtttatgctgtttggtgtaaggatcgaatgtccttagggaatttttctttaaaagtttcttacttcaactagaacttgttttacttgtacct

SEQ ID NO: 2894 - protein, 364 aa, Arabidopsis thaliana
MNNIDDAKTETSVSSGSSDSFLPLKKRMRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGEVNQESDKCFSCTQLFQKELTPSDVGKLNRLVIPKKYAVKYMPFISADQSEKEEGEIVGSVEDVEVVFYDRAMRQWKFRYCYWKSSQSFVFTRGWNSFVKEKNLKEKDVIAFYTCDVPNNVKTLEGQRKNFLMIDVHCFSDNGSVVAEEVSMTVHDSSVQVKKTENLVSSMLEDKETKSEENKGGFMLFGVRIECP

SEQ ID NO: 2895 - DNA, 1338 bp, Arabidopsis thaliana
atgtcgtttcgaggcattgttcaagatttgagagatgggtttgggagcttgtcaaggaggagtttcgattttaggctctcgagtcttcataaagggaaagctcagggttcttcgttccgtgagtattcgtcatcccgtgatctcttgtcgcctgtgatagttcagacaagtagatgggctaatcttcctccagagttactctttgatgtgatcaaaagattagaggaaagtgagagtaattggcctgcaagaaaacatgttgtggcttgtgcttcggtttgtcggtcttggagagctatgtgccaagagattgttttggggcctgaaatctgtgggaaactcactttccctgtttccctcaaacagccagggcctcgtgatgcaatgattcagtgtttcatcaaaagggataaatcaaagctaacatttcacctttttctttgtttaagtcccgctctattagtggagaatgggaaatttcttctttcagctaaaagaactcgtagaactactcgaaccgagtacattatctccatggatgctgataacatctcaagatccagcaactcttacctcggaaagctcagatcaaacttccttgggacaaagttcttggtgtacgacacgcaaccaccaccaaacacatcttcgagcgcacttatcactgatcgaacaagccgaagcaggtttcactccagacgagtttctcctaaagtaccatccggaagctacaacattgctcaaatcacctatgagctcaacgtgttgggcacacgcgggccacgacgaatgcactgcatcatgaactccatcccaatttcatcgctcgaaccaggcggttcagtccctaaccaacccgagaaactcgtccctgcaccatactctctcgacgactcattccgcagtaacatctccttctccaaatcatcatttgaccaccgctccctcgatttcagcagttctagattctccgaaatgggaatatcctgcgacgacaacgaagaagaagcgagtttcagaccgttgattctaaagaacaagcagccaaggtggcacgagcagttgcaatgctggtgtttgaatttccgcggacgtgtgacagttgcatcggttaagaatttccagcttgtagcagcaagacagccgcagcctcaagggacaggtgcagcagcagcaccaacaagtgcacctgctcaccctgagcaagacaaggtgattctccagtttggtaaagtagggaaagatatgttcacaatggactataggtatccattatcggcgtttcaggcgtttgcgatatgcttaagcagctttgacaccaagcttgcttgtgaatag

SEQ ID NO: 2896 - protein, 445 aa, Arabidopsis thaliana
MSFRGIVQDLRDGFGSLSRRSFDFRLSSLHKGKAQGSSFREYSSSRDLLSPVIVQTSRWANLPPELLFDVIKRLEESESNWPARKHVVACASVCRSWRAMCQEIVLGPEICGKLTFPVSLKQPGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPISSLEPGGSVPNQPEKLVPAPYSLDDSFRSNISFSKSSFDHRSLDFSSSRFSEMGISCDDNEEEASFRPLILKNKQPRWHEQLQCWCLNFRGRVTVASVKNFQLVAARQPQPQGTGAAAAPTSAPAHPEQDKVILQFGKVGKDMFTMDYRYPLSAFQAFAICLSSFDTKLACE

SEQ ID NO: 2897 - DNA, 894 bp, Arabidopsis thaliana
atggaagcgaagaaggaagagataaagaaaggtccatggaaagccgaagaagacgaagtactcatcaaccatgtcaagagatacggtcctcgtgattggagctccattcgatccaaaggtcttcttcaacgcaccggcaaatcctgtcgtcttcgttgggtcaataaactccgtcccaatctcaaaaatggatgcaagttctcggctgacgaagagaggactgtgattgagttacaatctgagtttggtaacaaatgggcgagaatcgctacgtatctaccgggaagaactgataacgatgtgaagaatttctggagtagcagacaaaagagactcgctaggattcttcataactcctctgatgcatcgagttcgagtttcaatcccaaatcttcttcttctcatcgactcaagggcaaaaacgtcaaaccaatccgtcaatcctctcagggttttggtttggttgaggaagaggttacagtttcttcttcatgttcccagatggttccttattcatctgatcaagttggtgatgaagtcttgaggttgccggatttgggtgttaagttagagcatcagcctttcgcttttggcactgatcttgtcctagcagagtactctgactcacagaatgatgcaaatcagcaagcaatcagccctttctctccagaaagcagagagcttttggctagacttgacgaccctttttactatgatatacttggaccagctgattcttctgagccattgttcgctctccctcagccgttcttcgagccttcgcctgtgccgagaagatgcagacatgtttcaaaggatgaagaagctgatgttttcttagacgatttcccagctgacatgtttgatcaggttgatccaatcccaagtccttag

SEQ ID NO: 2898 - protein, 297 aa, Arabidopsis thaliana
MEAKKEEIKKGPWKAEEDEVLINHVKRYGPRDWSSIRSKGLLQRTGKSCRLRWVNKLRPNLKNGCKFSADEERTVIELQSEFGNKWARIATYLPGRTDNDVKNFWSSRQKRLARILHNSSDASSSSFNPKSSSSHRLKGKNVKPIRQSSQGFGLVEEEVTVSSSCSQMVPYSSDQVGDEVLRLPDLGVKLEHQPFAFGTDLVLAEYSDSQNDANQQAISPFSPESRELLARLDDPFYYDILGPADSSEPLFALPQPFFEPSPVPRRCRHVSKDEEADVFLDDFPADMFDQVDPIPSP

SEQ ID NO: 2899 - DNA, 651 bp, Arabidopsis thaliana
atggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtag

SEQ ID NO: 2900 - protein, 216 aa, Arabidopsis thaliana
MEIEIRRGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLKCDVNSKQFKDTIKHLWMPRLIERIAATQSVQFTSNHYSPENSSVATATSSTSSSEAVRSSFYGGDQVEFGTLDHMTNGGYWFNGGDTFETLCSFDELNKWLIQ

SEQ ID NO: 2901 - DNA, 1878 bp, Arabidopsis thaliana
tctcagagcaaaaaacaaaaaaaaagaaaaaaaaaccctaaatctaaatctcaccttccacctctgtcttttttttttttgttcttttttttttttttactgtatcttctcttctctttgctctgcaaaaatctcacatccatggatccatctcttggtgatcctcatcatcctcctcagttcaccccttttcctcattttcccacctccaatcatcatcctttaggaccaaatccgtacaataaccatgtcgtcttccaaccgcagccgcaaacgcaaacgcaaatcccgcaaccgcagatgtttcagttatctccacatgtttcaatgccccaccctccttactccgaaatgatttgcgctgcgattgcggcgttaaacgaaccggatggttcgagcaagatggcaatttcgagatacatcgagagatgttacaccggtttaacttctgctcatgctgctttgttgactcaccatctcaagactttgaagaccagtggtgttctttctatggttaagaaatcttacaaaattgctggttcttctactcctcctgctagtgtagctgttgctgctgctgccgccgctcaaggtctcgatgttcccagatctgagattctccattcaagtaacaacgatcccatggcttctggctctgcttctcagcctctgaaacgaggtcgtggtcgtcctcctaagcctaaacctgaatctcaaccacaaccactacagcaacttccaccgaccaatcaagtccaggctaacggacagccaatctgggaacagcagcaagttcaatcacctgttccggttccgactccggttacagagtcggcgaagagaggacctggtcgtccaaggaagaacggttctgctgctcctgctactgcaccaatcgttcaagcttcggttatggctggaattatgaaacgtagaggtagaccaccgggtcgtcgagctgctgggagacagaggaagcccaaatccgtttcttctactgcctctgtgtatccttatgttgctaatggtgctagacgcagaggaaggcctaggagagttgttgaccctagcagtattgttagtgttgctccagtaggtggtgaaaatgtggcagcggttgcgccagggatgaagcgtggacgtggacgaccacctaagattggtggtgttatcagtaggcttattatgaagcctaagagaggacgaggacgtcctgtaggtagacccagaaagattggaacatcagtcacgactgggacacaagattctggagaactcaagaagaagtttgatatttttcaagagaaagtgaaagaaattgtgaaggtgttgaaggatggagttacaagtgagaatcaagcagtggtgcaagccataaaagatctggaagcactaacagtgacggagaccgttgagccacaagttatggaagaagtgcagccagaggagactgcagcaccacagactgaagctcaacaaactgaagctgctgagacacaaggaggacaagaagaaggacaagaaagagaaggagaaacacagacccagacagaagcagaggcaatgcaagaagctctgttctgaagaataataatgatctagaaaacaacctagacataatagccttggtgtttggcgttaggagtgtttttttttagttgttttaggtgttggaatcgcatcttaaattatataaaaatctataaggaattttaatttttctaggttttgttgtctgcagaagaagaaatagtagactcgttaatggtgttgttgtcggtgtgtctttaaccaaaccataagacgtggctgtaaattagcgatgtttctagtcttccatctttaataatctcttattgcgtctgtgcctttgttttt

SEQ ID NO: 2902 - protein, 480 aa, Arabidopsis thaliana
MDPSLGDPHHPPQFTPFPHFPTSNHHPLGPNPYNNHVVFQPQPQTQTQIPQPQMFQLSPHVSMPHPPYSEMICAAIAALNEPDGSSKMAISRYIERCYTGLTSAHAALLTHHLKTLKTSGVLSMVKKSYKIAGSSTPPASVAVAAAAAAQGLDVPRSEILHSSNNDPMASGSASQPLKRGRGRPPKPKPESQPQPLQQLPPTNQVQANGQPIWEQQQVQSPVPVPTPVTESAKRGPGRPRKNGSAAPATAPIVQASVMAGIMKRRGRPPGRRAAGRQRKPKSVSSTASVYPYVANGARRRGRPRRVVDPSSIVSVAPVGGENVAAVAPGMKRGRGRPPKIGGVISRLIMKPKRGRGRPVGRPRKIGTSVTTGTQDSGELKKKFDIFQEKVKEIVKVLKDGVTSENQAVVQAIKDLEALTVTETVEPQVMEEVQPEETAAPQTEAQQTEAAETQGGQEEGQEREGETQTQTEAEAMQEALF

SEQ ID NO: 2903 - DNA, 1653 bp, Arabidopsis thaliana
accaacaaaataaaagaaagaagcaaaaagaaaaagctcgaagataggaaaatgttaagggaagaatgtactccaagttcatcatggtgggaagatgttcaacatcatcataatgatcatgcaaactcgattagttcgacgtctttctaccataagagtagtaataataactcacacgccaacgctagctgtgaagaagacaatctctccgtctctaccgtacgcgcttcgaatcgtttggacctaaccgctgaatcctccaatcatcactctctctcggcttcgaatcagcctgcctcctcctccgatgagttgcttcgcgaccatgtagtatcttctcataatcatctatggagtcttgccttcttgcctggtagaagcttaggagatcaaatgatggatcatcatcatcacatagcatcaagaaattcatcaacaacatcagaattaccatcattcgagccagcgtgccataacggtaatggtaacggttggatctatgacccaaatcaagttaggtacgatcaaagtagtgaccaacggctgtcaaagttgacggatcttgtaggcaagcactggtcaattgcaccaccgaataatcccgacatgaaccataaccttcatcatcacttcgatcatgatcattctcaaaacgacgacatttctatgtacagacaagccttggaggtgaaaaatgaggaagatctttgttacaataatggctcaagtggtggtggttccttgttccatgatcctatagaaagttctagaagtttccttgatataaggttaagtaggccattaacggatattaatccgtcatttaagccatgctttaaggccttaaacgtatccgagtttaacaagaaagaacatcaaacggcatctctggcagcagtgagactgggaacaacaaacgctggaaaaaagaagagatgtgaagaaatttccgatgaggtttcaaagaaggccaagtgcagtgagggctctacactttcgccagagaaggaactacccaaagccaaacttcgagacaagatcacgactctacagcaaattgtgtctccctttggaaagactgatactgcttctgtgcttcaagaggccatcacttacataaatttttatcaagagcaagttaagctgctaagcactccttatatgaagaattcatcaatgaaggatccatgggggggatgggacagagaagatcacaacaaaaggggaccgaagcatcttgatctaaggagtagagggctttgtttggttcctatttcatataccccaatcgcataccgcgataacagtgcaactgactactggaatcccacgtatagaggttctttgtatcgttagtgactagtatagcaaaaagtgtgtagagagaaagatttgattaaattatggtagtggtaaaccattccaaacatcgatcattttatagggagcaagcagtaaaacgggagaagagtatgtgtacataaagtatatgcatattaatcattggggtcacacttctttgatttgcaattgttcttgcgtaacctaaaacattgtgttatggtcatatatagaataatacattaatattggagtttgaattagatatactacaatgtaataaaaagtagttaattaatggcatattccttg

SEQ ID NO: 2904 - protein, 434 aa, Arabidopsis thaliana
MLREECTPSSSWWEDVQHHHNDHANSISSTSFYHKSSNNNSHANASCEEDNLSVSTVRASNRLDLTAESSNHHSLSASNQPASSSDELLRDHVVSSHNHLWSLAFLPGRSLGDQMMDHHHHIASRNSSTTSELPSFEPACHNGNGNGWIYDPNQVRYDQSSDQRLSKLTDLVGKHWSIAPPNNPDMNHNLHHHFDHDHSQNDDISMYRQALEVKNEEDLCYNNGSSGGGSLFHDPIESSRSFLDIRLSRPLTDINPSFKPCFKALNVSEFNKKEHQTASLAAVRLGTTNAGKKKRCEEISDEVSKKAKCSEGSTLSPEKELPKAKLRDKITTLQQIVSPFGKTDTASVLQEAITYINFYQEQVKLLSTPYMKNSSMKDPWGGWDREDHNKRGPKHLDLRSRGLCLVPISYTPIAYRDNSATDYWNPTYRGSLYR

SEQ ID NO: 2905 - DNA, 1140 bp, Arabidopsis thaliana
aaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctgggctaaagagagcaggaaaaagttgtagattgagatggttgaattaccttaaacccgacataaagcgtgggaatctcactcctcaagaacaacttttaatccttgagctccattctaaatggggtaataggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtttatcggtcttttattaaattttgattgttttggattccttaaaaatgtgttcttattatagtttttaatgaaaaaaatgtttaagcgcaaaaaaaaaaaaaaaaaaaaaaaaaaaaaa

SEQ ID NO: 2906 - protein, 283 aa, Arabidopsis thaliana
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 2907 - DNA, 547 bp, Glycine max
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 2908 - DNA, 600 bp, Glycine max
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 2909 - DNA, 528 bp, Glycine max
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 2910 - DNA, 610 bp, Oryza sativa
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 2911 - DNA, 720 bp, Oryza sativa
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 2912 - DNA, 761 bp, Oryza sativa
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 2913 - DNA, 819 bp, Zea mays
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaacaaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaaaaaaaaaaaaaaaa

SEQ ID NO: 2914 - DNA, 803 bp, Zea mays
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 2915 - DNA, 302 bp, Glycine max
agaacttgttattgcaatgactgacatagatcgctcctctgataatgtttcttctgattctattgagaaatcaagccaagtttctgatgttgaattttctgaagctgaggaaatccttattgccatggtgtataatctggttggagaaaggtggtctttgattgctggaagaattcctggaagaactgcagaagaaatagagaaatattggacttcaagattttcgactagccaatgaagtggcagaaattaaacgaagcaagacaattttgggtgcctgcaactcattatacagtgactta

SEQ ID NO: 2916 - DNA, 241 bp, Glycine max
atggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 2917 - DNA, 244 bp, Glycine max
atggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactac

SEQ ID NO: 2918 - DNA, 249 bp, Glycine max
atggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactacc

SEQ ID NO: 2919 - DNA, 260 bp, Glycine max
atgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgta

SEQ ID NO: 2920 - DNA, 321 bp, Oryza sativa
gctctaaactaccataaaatcttaactcggcattttttttttcacgctaatggaaagtagcggtggaagccagctgggaaagaattccaaaacaagtgatggtcgtgaaacaaaagaagttaatagcactgcgcaaaattttgttcatttcacagaagaagaggaagatattgttttcagaatgcacaggcttgtcgggaacaggtgggaacttatagctggaagaataccgggaaggacagcagaagaagtagagaagttctgggcaattaaacatcaagccacatgatagcagaaagaggatgtttgccccaaaagtag

SEQ ID NO: 2921 - DNA, 356 bp, Oryza sativa
cataaggtcataacaagggtctgaggatcttagctagcacaagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtaca

SEQ ID NO: 2922 - DNA, 257 bp, Zea mays
ctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatt

SEQ ID NO: 2923 - DNA, 1219 bp, Glycine max
atggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggc

SEQ ID NO: 2924 - DNA, 1081 bp, Glycine max
caccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtgc

SEQ ID NO: 2925 - DNA, 1442 bp, Glycine max
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaaggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 2926 - DNA, 1291 bp, Oryza sativa
ctagacactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgag

SEQ ID NO: 2927 - DNA, 1068 bp, Oryza sativa
gctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaacacgcaagc

SEQ ID NO: 2928 - DNA, 1348 bp, Oryza sativa
cttcagaggcttcacctttcatcagcttagctagctagctgctcgatccggcggcgtgatcgatcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctagctagcacgctgatgcagctagcgttttttttgctcattcgcttgcttgcttaattat

SEQ ID NO: 2929 - DNA, 1437 bp, Zea mays
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcacgggcgaggccgaggccgcgcgcgcctacgacgtggccgcgcagcggttccgggggcgcgacgccgtcaccaacttccgcccgctcgcggagtcggacttggacccggacgccgccgccgagctccggttcctcgcgtcccggtccaaggccgaggtcgtcgacatgctccgcaagcacacctacggcgaggagctcgcgcagaacaggcgcgccttcgccgctgcggcggcgtccctggcctcgccgcagctgccgccggccaagaacactagcccggcggcggcgcgcgagcacatgttcgacaaggtgctgaccccgagcgacgtaggcaagctcaaccggctggtggtgccaaagcagcacgcggagcggttcttcccggcggccggcgccgggtcgacgcagctgtgcttccaggaccgcggcggggcgctgtggcagttccgctactcctactgggggagcagccagagctatgtcatgaccaaggggtggagccgcttcgtccgcgccgcacgacttgccgcgggggacaccgtcaccttctcccgcagcggcggcggccgatacttcatcgagtaccgccactgccagcgccggcgccgcgacgtcgatatcagcttcggcgacgctgccaccgtgccggcgtggccgaggccgatagttatcggaaccgcggccatgaataatgggggtgcaacggtggcgtccgccaccatcgccggccatgacatcgaggtggcagtggcaccctcgggggcgaggagcttcaggctcttcgggttcaatgttgagtgcagcggcgacgatgcaccggcaccggcacctgctcccgccgaagtggagtatgtcgacggcgacacctagtagcagcggcggcgtagagtgcgcagagagacgatgaacgatggtgatctactgatcagggaccttattacaccataggtggcgtgcatgccttgttgaatcttaattagtcatgtttttcgaaaaaaaa

SEQ ID NO: 2930 - DNA, 759 bp, Oryza sativa
atcaacctcgctcgcttactcgtgtttaggcatggacgtttctgctgcgctcagcagcgactactcgtcggggacgccgtcgccggtggcggccgacgctgacgacggctcctccgcctacatgacggtgtcgtcggcgccgcccaagcggcgggcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctacctcgacatggcgcaagggatgctcattgacccgcctccaatggcctgtgatcctgccgtaggtggcggcgaagacgacaacgatggcgaggtccagctatggagctactgatcctgcgcgtttgaactcaacttggtttggcgcgaagagatcgcatgtacagc

SEQ ID NO: 2931 - DNA, 698 bp, Oryza sativa
ccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttt

SEQ ID NO: 2932 - DNA, 813 bp, Oryza sativa
cactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacgg

SEQ ID NO: 2933 - DNA, 765 bp, Oryza sativa
ctttcctcccaaatcaagaccaaatcggataatttcaaatccttgtcgagtgaactgatccatcgatggagtgggcgtactacggcagtgggtactcctcgtcggggacgccgtcgccggtgggcggcgacggggacgaggactcgtacatgacggtgtcgtcggcgccgcccaagcggcgggcggggaggaccaagttcaaggagacgaggcacccggtgtacaagggcgtgcgcagcaggaaccccgggaggtgggtctgcgaggtgcgcgagccgcacggcaagcagaggatctggctcggcaccttcgagaccgccgagatggcggcgcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagc

SEQ ID NO: 2934 - DNA, 847 bp, Oryza sativa
cgccgccaacaccaaccaactgcggcttgagacgtcgcgcgcgacatggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctagcatcaaattaaccaaacaatcttcactagcttgttggatgtagtagtagcagttctagctagcacaagtgcagaacacaaaaggatcgttt

SEQ ID NO: 2935 - DNA, 895 bp, Oryza sativa
cactcgagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgaggcacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtccaccccacgcaccgacgacgacgaggagtccgccgccaccgacggcgacgagtcctcctccccggccagcgacctggcgttcgaactggacgtcctgagtgacatgggctgggacctgtactacgcgagcttggcgcaggggatgctcatggagccaccatcggcggcgctcggcgacgacggtgacgccatcctcgccgacgtcccactctggagctactagagctcaatcaactgtacaattttgcctcttttttctctcttttctggcttccgatgccaaaattttggtactgtacggacactactttcggtaatgtgatggaacaagttgc

SEQ ID NO: 2936 - DNA, 976 bp, Zea mays
cacgcgtccgctcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggacgacttcctccgccatcagctggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaatgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctgtggcgcctaattttggcagtgtaaaacggttacttcttttggtaatgagatggaacaagtttgcgaaacatgaaaacagagcatgctaatcgacattttcgcgcggccgaaaaaaaaaaaaaaaaaaaaaaaaaaaaaaaaaaaaaaaag

SEQ ID NO: 2937 - DNA, 1160 bp, Oryza sativa
cggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcaggc

SEQ ID NO: 2938 - DNA, 1143 bp, Oryza sativa
ctctgcaggtgaggtgaggtgaggggtgggatcgagggatcgagaagctggcggcgagcaagtggtgggagcgcgccgatgagggcgccatggccgggatggatcccaccggcggcggtggcggcggcggcgtggcggcgcactacctacacatgctccgcgcgcagcagcaccagccactgtccccggcaggtgacgtcaaggcggagcggtccatgctgtcgccggatgagagccccggcgcggacgccgacctaggatcggaccacccgacgtcgtcggccatggtggcggcggaggacagcggcggcggcagcggttcgggtggcccgatgcggcgcccccgcgggaggccgctgggctccaagaacaagcccaagccgcccatcatcgtgacgcgggacagccccaacgcgttccactcccacgtcctcgaggtcgccgcgggaaccgacatcgtcgagtgcgtctgcgagttcgcgcgccgccgcggccgcggcgtctccgtgctcagcggtggcggcgccgtcgccaacgtcgcgctccgccagccaggcgcgtcgcccccgggcagcctggtcgccaccatgcgcggccagttcgagatcctgtccctcacgggcaccgtcctcccgccgcccgcgccgcccagcgccagcggcctcaccgtcttcctctccggcgggcagggccaggtggtcggcgggagcgtggccggccagctcatcgccgcggggccagtcttcctcatggccgcctcgttcgccaatgccgtctacgagcgtctgccactcgatggggaggatccggaggcagaggctgccgccgccacccctcccggcgatgcggcgcagccaaccggcccaccaccaccgcagcagcagcccacagcctcgcagtcctctgaggtgaccgccggtgacggcggcggcggcggcggtctcggcatgtatcttggaggccatgtgggatcctaccagcagcagcagcagcaacttcccggaccaggagacaacttcggtagctggagcggcagcatcaggccgccgccattctgatccaaacacctcaaatcaagctctcccccaacaacgccatgcatgtctaaatcctcacaagattcactccaagaagacgaagctg

SEQ ID NO: 2939 - DNA, 579 bp, Oryza sativa
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 2940 - DNA, 514 bp, Oryza sativa
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 2941 - DNA, 375 bp, Oryza sativa
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 2942 - protein, 179 aa, Glycine max
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 2943 - protein, 446 aa, Glycine max
MMSLSVSPSLGSPYHMKCELRGLVLIHLLLAGANFVATGDLQYAYLTLEQISQHASLDGDTMQRIASYVSEALADRILKTWPGIHRALNSSRITMVSDEILVQKLFFELLPFLKFSYILTNQAIVEAMEGEKMVHIVDLYGAGPAQWISLLQVLSARPEGPPHLRITGVHHKKEVLDQMAHKLTEEAEKLDIPFQFNPVLSKLENLDFNKLRVKTGEALAISSIMQLHSLLALDEDASRRKSPLLSKNSNAIHLQKGLLMNHNTLGDLLDGYSPSPDSASSSPAASSSALMNSESFLNALWGLSPKVMVVTEQDFNHNCLTMMERLAEALFSYAAYFDCLESTVSRASMDRLKLEKMLFGEEIKNIIACEGCERKERHEKMDRWIQRLDLSGFANVPISYYGMLQGRRFLQTYGCEGYKMREECGRVMICWQERSLFSITAWRPRK

SEQ ID NO: 2944 - DNA, 1329 bp, Oryza sativa
atggtccaggacgaaggctcgtcgtcgtcggtgacatcctccccgctccacaacttctccaacatgccgctccacccggccgcggcggcgtcgcccacgccgccatggatggtgcgggagctgcgttccgacgagcgcgggctgtgcctcatccatctcctgctcaactgcgccgcggcggcggcggccgggcggcttgatgctgcgaacgccgcgctcgagcacatcgcgtcgctggcggcgcccgacggggacgccatgcagcgcgtggcggccgccttcgcggaggcgctggcgcggcgcgcgctgagggcgtggcctgggctgtgccgcgcgctgctcctgccccgcgcgtcgcccacgccggccgaggtcgctgccgcgcgccgccacttcctcgacctctgcccgttcctccgcctcgccggcgccgccgccaaccagtcgatactggaggccatggagtccgagaagatcgtgcacgtcatcgacctcggcggcgccgacgccacgcaatggctggagctcctccacctcctcgccgcgcgccccgagggcccgccgcacctgcgcctcacgtcggtgcacgagcacaaggaactcctcacccagacagccatggcgctcacgaaagaagcagagcgcctcgacgtgccgttccagttcaacccggtggtgtcccgcctcgacgccctcgacgtggagtccctccgcgtgaagaccggcgaggccctcgccatctgctccagcctccagctgcactgcctcctggcgtccgacgacgacgccgccgccgtggcgggcggcgacaaggagaggcggagcccggagtccgggctgtcgccgtcgacgtcgcgcgcggacgcgttcctgggcgcgctgtgggggctgtcgccgaaggtgatggtggtggcggagcaggaggcgagccacaacgcggcggggctgacggagaggttcgtggaggcgctcaactactacgcggcgctgttcgactgcctggaggtgggggcggcgcgcgggtcggtggagcgcgcgcgcgtggagcggtggctgctcggggaggagatcaagaacatcgtggcgtgcgacggcggcgagcggcgggagcggcacgagcggctggagcggtgggcgcggcggctggagggcgccggcttcggccgcgtcccgctcagctactacgcgctgctccaggcgcggcgggtggcgcagggcctcggctgcgacggcttcaaggtccgggaggagaagggcaacttcttcctctgctggcaagatcgcgccctcttctccgtctccgcatggcgcggccgccgcttcgactga

SEQ ID NO: 2945 - DNA, 920 bp, Oryza sativa
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 2946 - protein, 193 aa, Oryza sativa
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 2947 - DNA, 555 bp, Glycine max
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 2948 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 2949 - DNA, 556 bp, Glycine max
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 2950 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 2951 - protein, 177 aa, Glycine max
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 2952 - protein, 222 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 2953 - protein, 191 aa, Glycine max
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 2954 - protein, 297 aa, Oryza sativa; identical to SEQ ID NO: 782

SEQ ID NO: 2955 - protein, 174 aa, Arabidopsis thaliana
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 2956 - protein, 189 aa, Oryza sativa; identical to SEQ ID NO: 787

SEQ ID NO: 2957 - protein, 185 aa, Oryza sativa
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 2958 - protein, 215 aa, Arabidopsis thaliana
MTEESPEEDHGSPGVAETNPGSPSSKTNNNNNNNKEQDRFLPIANVGRIMKKVLPGNGKISKDAKETVQECVSEFISFVTGEASDKCQREKRKTINGDDIIWAITTLGFEDYVAPLKVYLCKYRDTEGEKVNSPKQQQQRQQQQQIQQQNHHNYQFQEQDQNNNNMSCTSYISHHHPSPFLPVDHQPFPNIAFSPKSLQKQFPQQHDNNIDSIHW

SEQ ID NO: 2959 - protein, 160 aa, Arabidopsis thaliana
MAGNYHSFQNPIPRYQNYNFGSSSSNHQHEHDGLVVVVEDQQQEESMMVKEQDRLLPIANVGRIMKNILPANAKVSKEAKETMQECVSEFISFVTGEASDKCHKEKRKTVNGDDICWAMANLGFDDYAAQLKKYLHRYRVLEGEKPNHHGKGGPKSSPDN

SEQ ID NO: 2960 - protein, 139 aa, Arabidopsis thaliana
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 2961 - protein, 234 aa, Arabidopsis thaliana
MERGGFHGYRKLSVNNTTPSPPGLAANFLMAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 2962 - protein, 149 aa, Artificial sequence
  Consensus sequence
  misc_feature (2)..(2): Xaa can be any naturally occurring amino acid
  misc_feature (4)..(20): Xaa can be any naturally occurring amino acid
  misc_feature (23)..(54): Xaa can be any naturally occurring amino acid
  misc_feature (71)..(71): Xaa can be any naturally occurring amino acid
  misc_feature (100)..(100): Xaa can be any naturally occurring amino acid
  misc_feature (133)..(133): Xaa can be any naturally occurring amino acid
  misc_feature (141)..(142): Xaa can be any naturally occurring amino acid
  misc_feature (146)..(146): Xaa can be any naturally occurring amino acid
MXDXXXXXXXXXXXXXXXXXGGXXXXXXXXXXXXXXXXXXXXXXXXXXXXXXXXEQDRFLPIANVSRIMKXALPANAKISKDAKETVQECVSEFISFITXGEASDKCQREKRKTINGDDLLWAMTTLGFEDYXEPLKVYLXXYREXEGE
